US010400015B2

(12) United States Patent
Kwong et al.

(10) Patent No.: US 10,400,015 B2
(45) Date of Patent: Sep. 3, 2019

(54) RECOMBINANT HIV-1 ENVELOPE PROTEINS AND THEIR USE

(71) Applicant: The United States of America, as represented by the Secretary, Department of Health and Human Services, Washington, DC (US)

(72) Inventors: Peter Kwong, Washington, DC (US); Marie Pancera, Seattle, WA (US); Tongqing Zhou, Boyds, MD (US); Ivelin Georgiev, Nashville, TN (US); Michael Gordon Joyce, Bethesda, MD (US); Priyamvada Acharya, Fort Lee, NJ (US); Jason Gorman, Washington, DC (US); Yongping Yang, Potomac, MD (US); Aliaksandr Druz, Germantown, MD (US); Guillaume Stewart-Jones, Bethesda, MD (US); Rita Chen, Bethesda, MD (US); Gwo-Yu Chuang, Beethesda, MD (US); Ulrich Baxa, Frederick, MD (US); John Mascola, Rockville, MD (US); Rebecca Lynch, Washington, DC (US); Baoshan Zhang, Bethesda, MD (US); Cheng Cheng, Rockville, MD (US)

(73) Assignee: The United States of America, as represented by the Secretary, Department of Health and Human Services, Bethesda, MD (US)

( * ) Notice: Subject to any disclaimer, the term of this patent is extended or adjusted under 35 U.S.C. 154(b) by 0 days.

(21) Appl. No.: 15/508,885

(22) PCT Filed: Sep. 4, 2015

(86) PCT No.: PCT/US2015/048729
§ 371 (c)(1),
(2) Date: Mar. 3, 2017

(87) PCT Pub. No.: WO2016/037154
PCT Pub. Date: Mar. 10, 2016

(65) Prior Publication Data
US 2017/0233441 A1  Aug. 17, 2017

Related U.S. Application Data

(60) Provisional application No. 62/136,480, filed on Mar. 21, 2015, provisional application No. 62/046,059, filed on Sep. 4, 2014.

(51) Int. Cl.
| | |
|---|---|
| *C07K 14/435* | (2006.01) |
| *A61K 39/21* | (2006.01) |
| *G01N 33/569* | (2006.01) |
| *A61K 39/12* | (2006.01) |
| *C07K 14/005* | (2006.01) |
| *C07K 16/10* | (2006.01) |
| *A61K 39/00* | (2006.01) |

(52) U.S. Cl.
CPC ............ *C07K 14/435* (2013.01); *A61K 39/12* (2013.01); *A61K 39/21* (2013.01); *C07K 14/005* (2013.01); *C07K 16/1063* (2013.01); *G01N 33/56988* (2013.01); *A61K 2039/55555* (2013.01); *A61K 2039/55561* (2013.01); *A61K 2039/55577* (2013.01); *C12N 2740/16022* (2013.01); *C12N 2740/16034* (2013.01); *C12N 2740/16122* (2013.01); *C12N 2740/16134* (2013.01); *G01N 2333/162* (2013.01); *G01N 2469/20* (2013.01)

(58) Field of Classification Search
None
See application file for complete search history.

(56) References Cited

U.S. PATENT DOCUMENTS

| | | | |
|---|---|---|---|
| 6,689,879 B2 * | 2/2004 | Barnett ................ | C07K 14/005 435/320.1 |
| 9,738,688 B2 * | 8/2017 | Caulfield ............... | A61K 39/21 |
| 2014/0212458 A1 | 7/2014 | Caulfield | |

FOREIGN PATENT DOCUMENTS

| | | |
|---|---|---|
| EP | 2873423 | 5/2015 |
| WO | WO 2013/189901 | 12/2013 |
| WO | WO 2014/022475 | 2/2014 |

OTHER PUBLICATIONS

Acharya, et al. "Structural definition of an antibody-dependent cellular cytotoxicity response implicated in reduced risk for HIV-1 infection." *Journal of Virology* 88, No. 21 (2014): 12895-12906.
Cheng, et al. "Immunogenicity of a prefusion HIV-1 envelope trimer in complex with a quaternary-structure-specific antibody." *Journal of virology* 90, No. 6 (2016): 2740-2755.

(Continued)

*Primary Examiner* — Agnieszka Boesen
(74) *Attorney, Agent, or Firm* — Klarquist Sparkman, LLP

(57) ABSTRACT

HIV-1 Env ectodomain trimers stabilized in a prefusion mature closed conformation and methods of their use and production are disclosed. In several embodiments, the HIV-1 Env ectodomain trimers and/or nucleic acid molecules can be used to generate an immune response to HIV-1 in a subject. In additional embodiments, the therapeutically effective amount of the HIV-1 Env ectodomain trimers can be administered to a subject in a method of treating or preventing HIV-1 infection.

51 Claims, 97 Drawing Sheets

Specification includes a Sequence Listing.

(56) References Cited

OTHER PUBLICATIONS

Chow, et al. "Conserved structures exposed in HIV-1 envelope glycoproteins stabilized by flexible linkers as potent entry inhibitors and potential immunogens." *Biochemistry* 41, No. 22: 7176-7182 (2002).
Doria-Rose, et al. "Developmental pathway for potent V1V2-directed HIV-neutralizing antibodies." *Nature* 509, No. 7498: 55-62 (2014).
Georgiev, et al. "Delineating antibody recognition in polyclonal sera from patterns of HIV-1 isolate neutralization." *Science* 340, No. 6133: 751-756 (2013).
Guenaga, et al. "Structure-guided redesign increases the propensity of HIV Env to generate highly stable soluble trimers." *Journal of virology* 90, No. 6 (2016): 2806-2817.
Julien, et al. "Crystal structure of a soluble cleaved HIV-1 envelope trimer." *Science* 342, No. 6165: 1477-1483 (2013).
Kanekiyo, et al. "Self-assembling influenza nanoparticle vaccines elicit broadly neutralizing H1N1 antibodies." *Nature* 499, No. 7456 (2013): 102-106.
Kassa, et al. "Stabilizing exposure of conserved epitopes by structure guided insertion of disulfide bond in HIV-1 envelope glycoprotein." *PloS One* 8, No. 10: e76139 (2013).
Kwon, et al. "Crystal structure, conformational fixation and entry-related interactions of mature ligand-free HIV-1 Env." *Nature Structural & Molecular Biology* 22, No. 7: 522-531 (2015).
Lyumkis, et al. "Cryo-EM structure of a fully glycosylated soluble cleaved HIV-1 envelope trimer." *Science* 342, No. 6165: 1484-1490 (2013).
Pancera, et al. "Structure and immune recognition of trimeric pre-fusion HIV-1 Env." *Nature* 514, No. 7523: 455-461 (2014).
Sanders, et al. "A next-generation cleaved, soluble HIV-1 Env trimer, BG505 599 SOSIP. 664 gp140, expresses multiple epitopes for broadly neutralizing but not non-neutralizing 600 antibodies." *PLoS Pathogens* 9: e1003618 (2013).
Chuang, et al. "Structure-based design of a soluble prefusion-closed HIV-1-Env trimer with reduced CD4 affinity and improved immunogenicity." *Journal of Virology* (2017): JVI-02268.
Georgiev, et al. "Single-chain soluble BG505. SOSIP gp140 trimers as structural and antigenic mimics of mature closed HIV-1 Env." *Journal of Virology* (2015): JVI-03451.
Joyce, et al. "Soluble prefusion closed DS-SOSIP. 664-Env trimers of diverse HIV-1 strains." *Cell Reports* 21, No. 10 (2017): 2992-3002.

\* cited by examiner

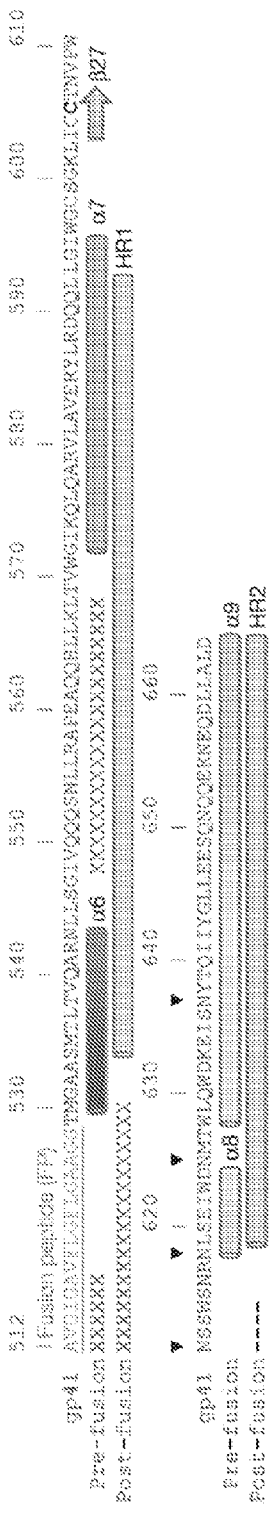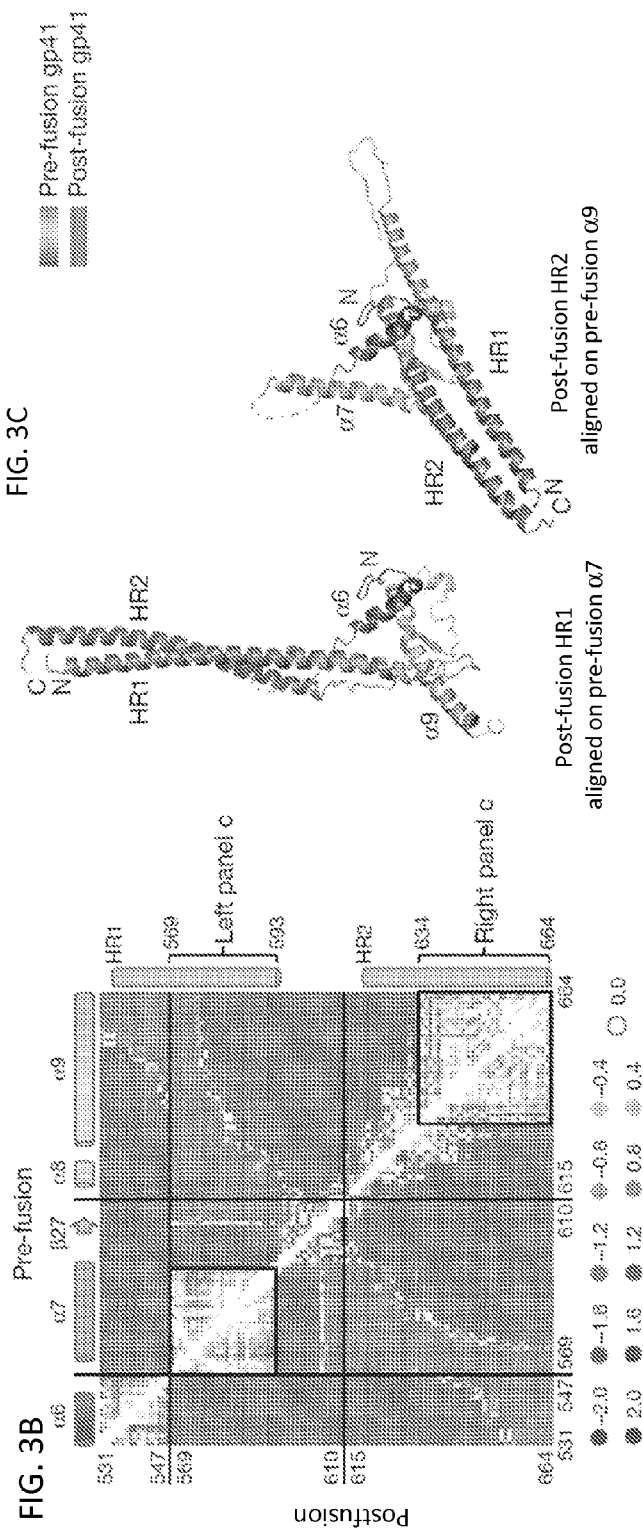
FIG. 3A
FIG. 3B
FIG. 3C

FIG. 4A
Prefusion versus postfusion conformations
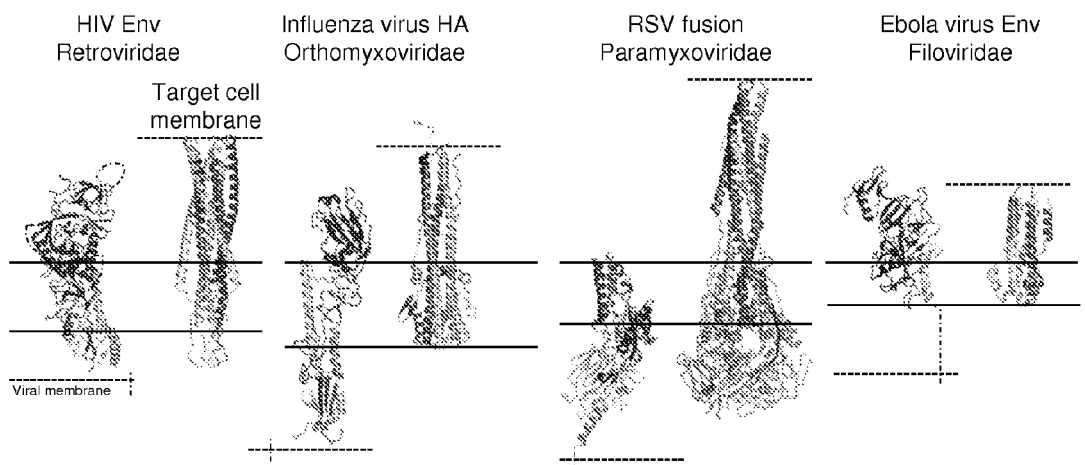
FIG. 4B
Prefusion contains preformed C terminal helix of postfusion coiled coil
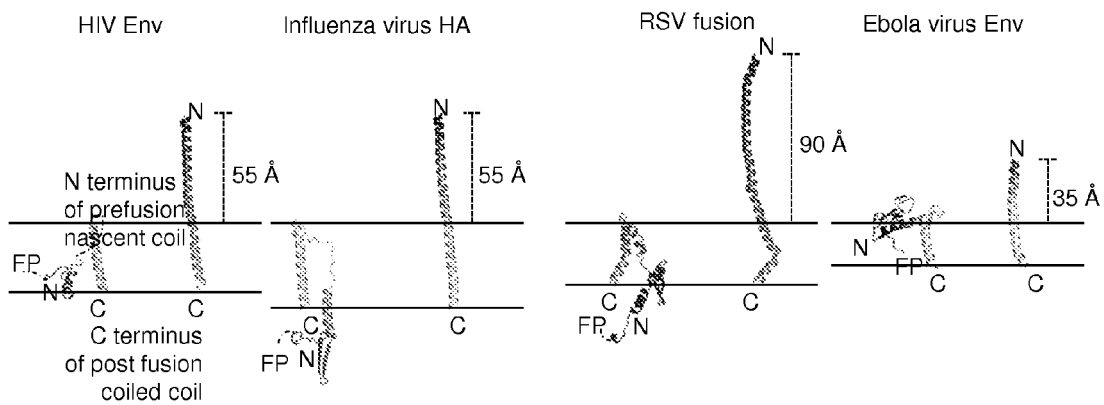
FIG. 4C
Prefusion topology
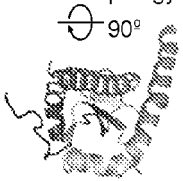
gp41 encircles
N/C temini
HA2 encircles
N teminus
F1 encircles
N teminus
gp2 encircles
N/C temini

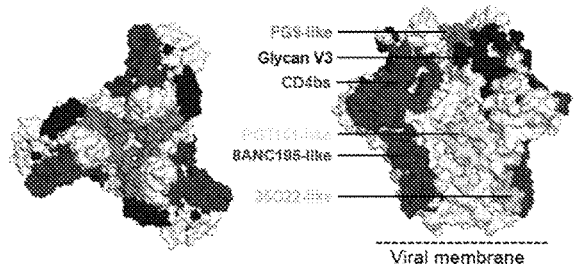
FIG. 6A
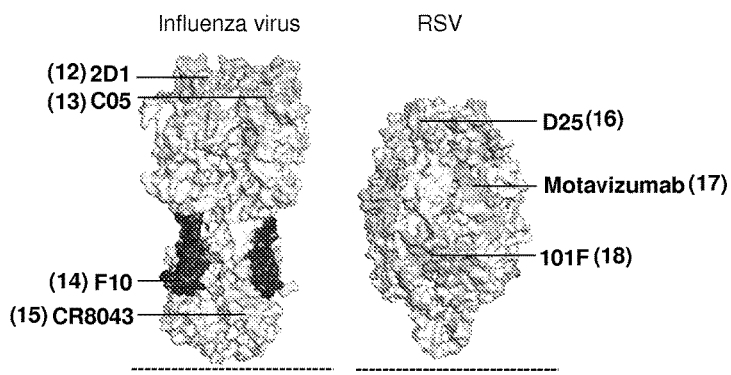
FIG. 6B
FIG. 6C
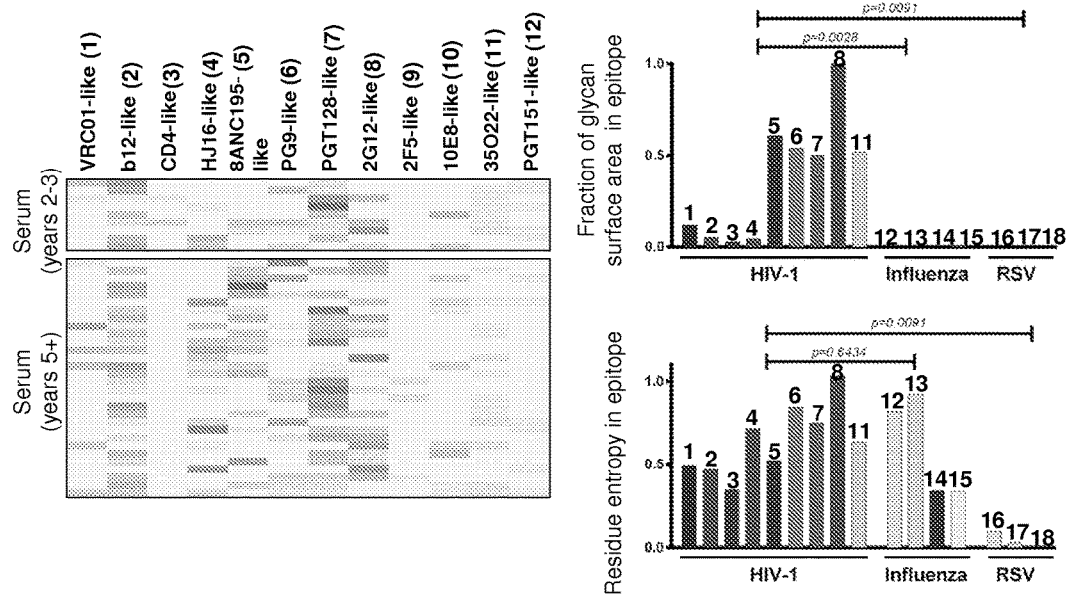

Serum (years 2-3)

90°

Viral membrane

Serum (years 5+)

90°

Viral membrane

Observed serum prevalence

0%  100%

PG9-like (20%)

PGT128-like (53%)

b12-like (40%)

8ANC195-like (20%)

Viral membrane

FIG. 9
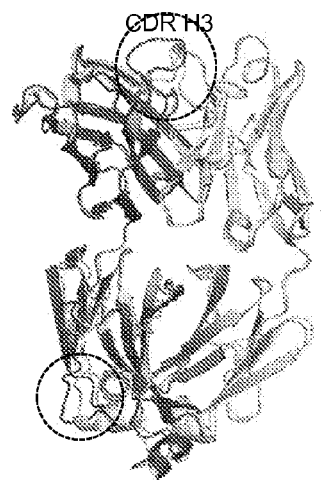
35O22 bound vs unbound
Heavy chain    Light chain
Rmsd all atoms: 0.687
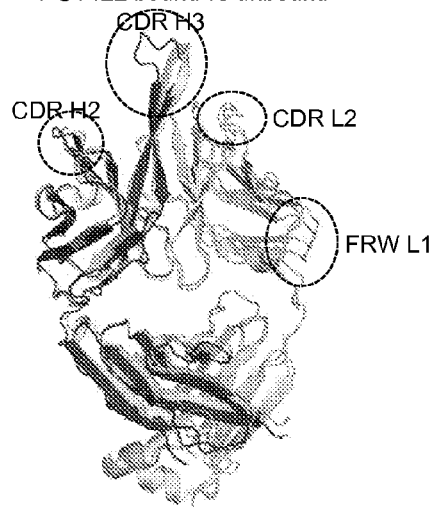
PGT122 bound vs unbound
Heavy chain    Light chain
Rmsd all atoms: 1.268
FIG. 10A
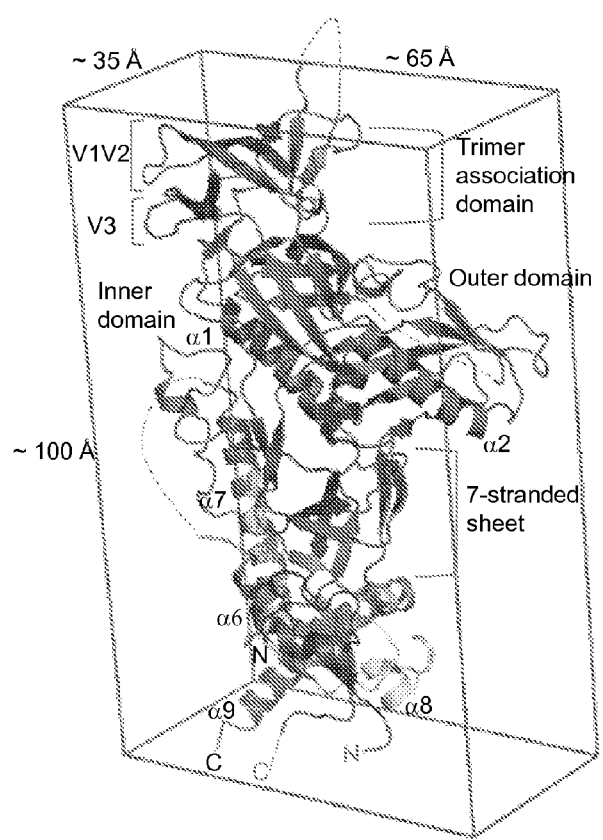
FIG. 10B
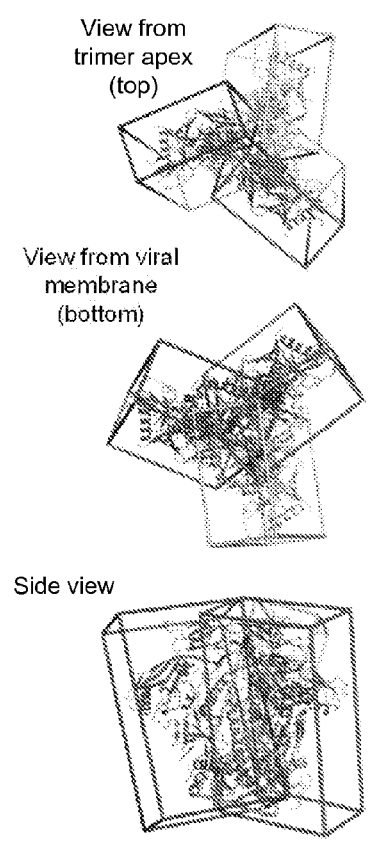
View from trimer apex (top)
View from viral membrane (bottom)
Side view

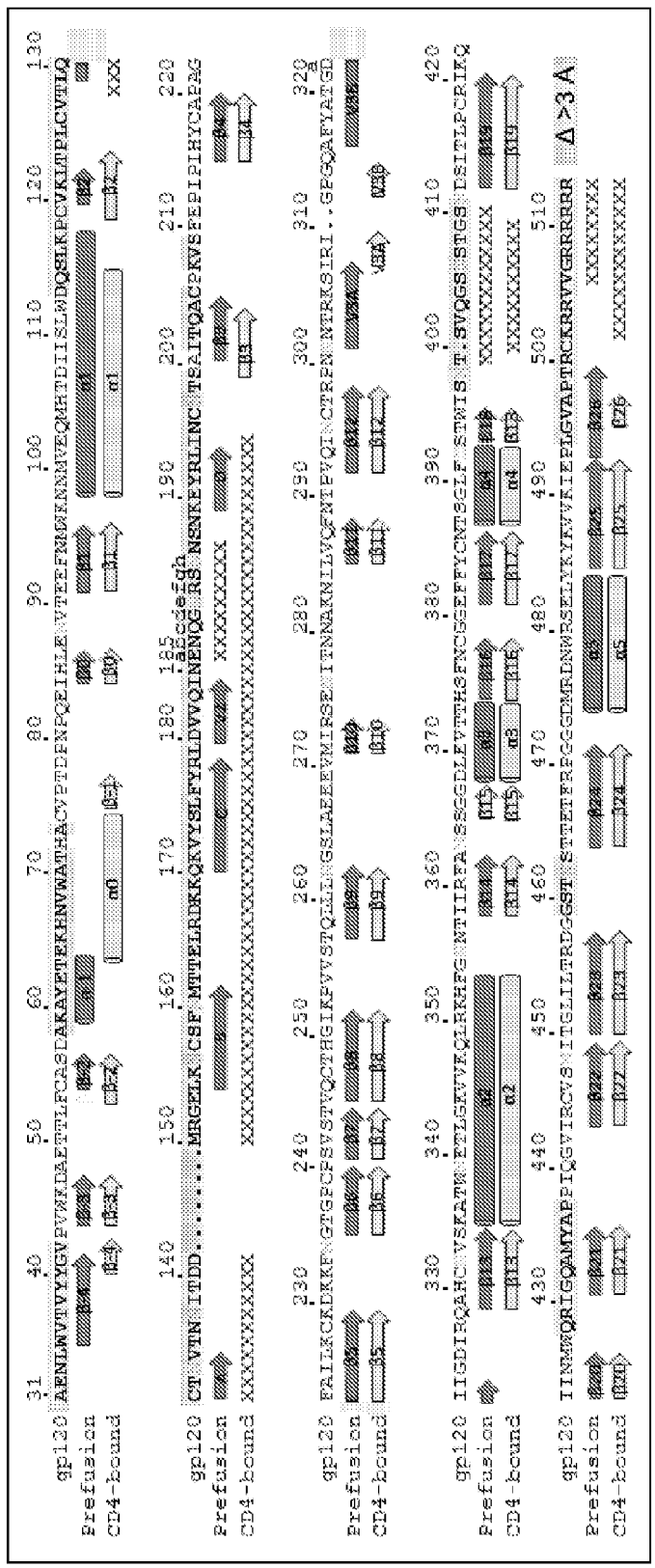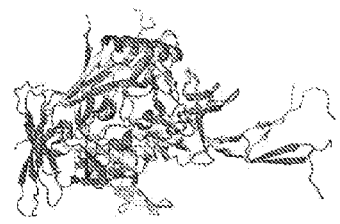
FIG. 11A

FIG. 11B
Layer 1 changes – α0
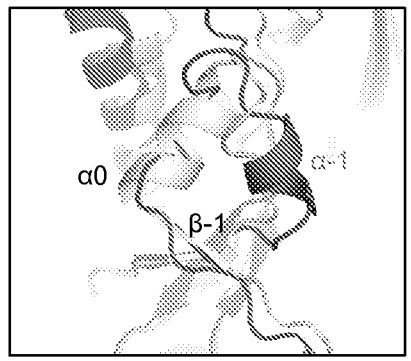
β20-21 changes
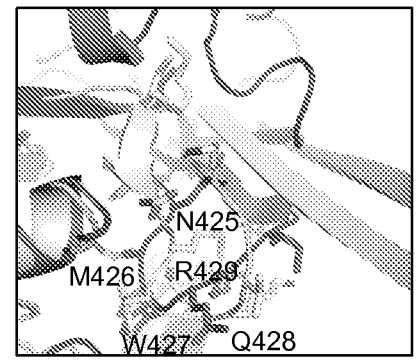
Layer 2 changes – α1
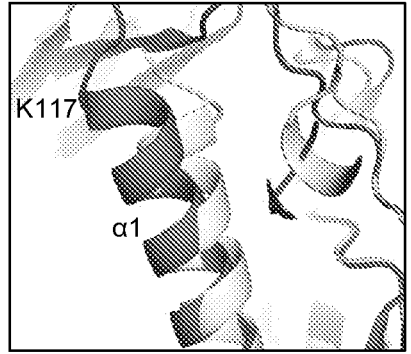
α1- β20-21 changes
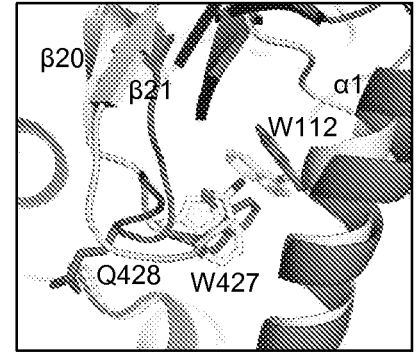

FIG. 12A

Man-9 N-linked glycan coverage for trimers using probe radii of 1.4 and 10 Å

| | Probe Radius (R=1.4 Å) | |
|---|---|---|
| | Fraction Glycan Covered | Fraction Glycan Free |
| HIV | 0.70 | 0.30 |
| HIV$_{246/616}$ | 0.73 | 0.27 |
| Flu | 0.54 | 0.46 |
| RSV | 0.25 | 0.75 |

| | Probe Radius (R=10.0 Å) | |
|---|---|---|
| | Fraction Glycan Covered | Fraction Glycan Free |
| HIV | 0.93 | 0.07 |
| HIV$_{246/616}$ | 0.98 | 0.02 |
| Flu | 0.86 | 0.14 |
| RSV | 0.52 | 0.48 |

FIG. 12B

Man-5 N-linked glycan coverage for trimers using two probe radii of 1.4 and 10 Å

| | Probe Radius (R=1.4 Å) | |
|---|---|---|
| | Fraction Glycan Covered | Fraction Glycan Free |
| HIV | 0.60 | 0.40 |
| HIV$_{246/616}$ | 0.64 | 0.36 |
| Flu | 0.44 | 0.56 |
| RSV | 0.19 | 0.81 |

| | Probe Radius (R=10.0 Å) | |
|---|---|---|
| | Fraction Glycan Covered | Fraction Glycan Free |
| HIV | 0.88 | 0.12 |
| HIV$_{246/616}$ | 0.95 | 0.05 |
| Flu | 0.76 | 0.24 |
| RSV | 0.42 | 0.58 |

FIG. 12C

Probe Radius (R =1.4 Å)   Probe Radius (R =10 Å)

HIV
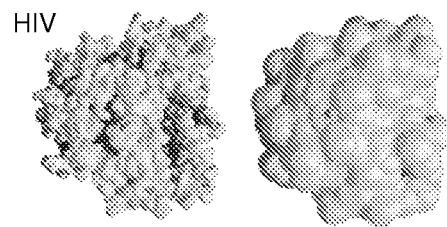

HIV$_{246/616}$
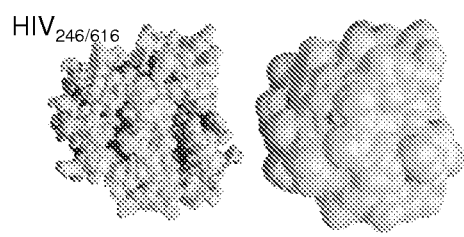

Flu
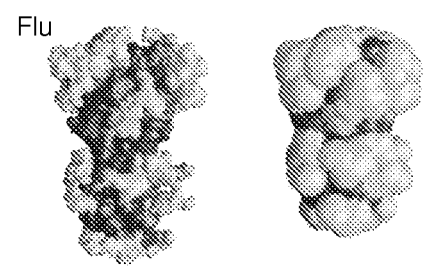

RSV
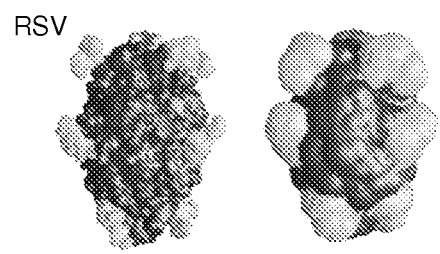

| | BG505 SOSIP.664 with PGT122 and 35O22 |
|---|---|
| Data collection | |
| Space group | P6$_3$ |
| Cell dimensions | |
|    $a, b, c$ (Å) | 128.89, 128.89, 313.42 |
|    $\alpha, \beta, \gamma$ (°) | 90.0, 90.0, 120.0 |
| Resolution (Å) | 50-3.10 (3.68-3.49, 3.49-3.34, 3.34-3.21, 3.21-3.10)* |
| $R_{sym}$ or $R_{merge}$ | 11.6 (44.9, 52.7, 68.3, 75.5) |
| $I/\sigma I$ | 11.3 (2.22, 1.95, 1.43, 1.11) |
| Completeness (%) | 73.4 (57.2, 40.6, 33.9, 27.8) |
| Redundancy | 3.8 (3.3, 3.4, 3.3, 3.0) |
| | |
| Refinement | |
| Resolution (Å) | 40.739-3.098 (3.4893-3.3375; 3.3375-3.2091; 3.2091-3.0984) |
| No. reflections | 29,353 |
| $R_{work}/R_{free}$ | 0.2135/0.2480 (0.3056/0.3484; 0.3348/0.3315; 0.4039/0.4056) |
| No. atoms | 12189 |
|    Protein | 11345 |
|    Ligand (glycans) | 757 |
|    Sulfate ion | 50 |
|    Water | 37 |
| B-factors | 109.50 |
|    Protein | 109.30 |
|    Ligand (glycans) | 113.34 |
|    Sulfate ion | 140.95 |
|    Water | 40.20 |
| R.m.s deviations | |
|    Bond lengths (Å) | 0.002 |
|    Bond angles (°) | 0.575 |
| Ramachadran Favored % | 92.66 |
| Ramachadran Allowed % | 99.03 |
| MolProbity all-atoms clashscore | 5.36 |
| MolProbity score | 1.80 |
| | |
| PDB ID | 4TVP |

*Highest resolution shell is shown in parenthesis.

FIG. 15

|  | Prefusion mature closed state | Prefusion partially open intermediate | Prefusion receptor-bound open intermediate | Postfusion |
|---|---|---|---|---|
| gp120 | Crystal structure (4TVP) | Crystal structure (4TVP) | Crystal structure of core (3JWD) with modeled V3 (3HI1) and V1V2 (3U4E) | Crystal structure of core (3JWD) with modeled V3 (3HI1) and V1V2 (3U4E) |
| V1V2 | Native | Rotated 6° | Rotated to align with bridging sheet | Rotated to align with bridging sheet |
| V3 | Native | Rotated 6° | Protruding towards target cell | Protruding towards target cell |
| Core | Native | Rotated 6° | Rotated 50° | Rotated 50° |
| N+C-term | Native | Native | Unknown | Rotated 45° |
| gp41 | Crystal structure (4TVP) | Crystal structure (4TVP) with modeled α7 | Crystal structure (4TVP) with modeled α7 and α6 removed | Crystal structure (chimera of 2X7R and 2EZO) |
| α6 | Native | Disassembling to α7 | Disassembled | Extended to postfusion HR1 |
| α7 | Native | Extending | Extended with fusion peptide | Extended to postfusion HR1 |
| α8 | Native | Native | Native | Extended to postfusion HR2 |
| α9 | Native | Native | Native | Extended to postfusion HR2 |

FIG. 16A

Binding of antibodies 35O22, PGT151 and PGT145 to trimeric BG505 SOSIP.664

| Analyte | Capture antibody | Interaction surface | K$_D$ (± SE) (nM)‡ | k$_{on}$ (± SE) (M$^{-1}$s$^{-1}$) ‡ | k$_{off}$ (± SE) (s$^{-1}$) ‡ | R$_{max}$ (± SE) (RU) ‡ # |
|---|---|---|---|---|---|---|
| 35O22 | 2G12 | Trimer | 3.36 ± 0.059 | 2.41 X 10$^4$ ± 56 | 8.12 X 10$^{-5}$ ± 1.4 X 10$^{-6}$ | 124.7 ± 0.17 |
| | CD4 Ig | Trimer | 27.96 ± 0.11 | 2.91 X 10$^4$ ± 80 | 8.14 X 10$^{-4}$ ± 2.8 X 10$^{-6}$ | 77.4 ± 0.09 |
| | 17b | Trimer + sCD4 | 27.20 ± 0.21 | 2.63 X 10$^4$ ± 1.7 X 10$^2$ | 7.16 X 10$^{-4}$ ± 3.2 X 10$^{-6}$ | 438.9 ± 0.45 |
| PGT151 | 2G12 | Trimer | 144.3 ± 2.5 | 1.54 X 10$^5$ ± 2.0 X 10$^3$ | 2.23 X 10$^{-2}$ ± 2.6 X 10$^{-4}$ | 92.6 ± 0.28 |
| | CD4 Ig | Trimer | 106 ± 0.93 | 1.56 X 10$^5$ ± 1.0 X 10$^3$ | 1.66 X 10$^{-2}$ ± 9.9 X 10$^{-5}$ | 18.1 ± 0.06 |
| | 17b | Trimer + sCD4 | NBD* | NBD* | NBD* | NBD* |
| PGT145 | 2G12 | Trimer | 22.80 ± 0.41 | 1.25 X 10$^5$ ± 7.6 X 10$^2$ | 2.85 X 10$^{-3}$ ± 4.8 X 10$^{-5}$ | 32.6 ± 0.13 |

FIG. 16B

Estimate of binding stoichiometry for 35O22, PGT151 and PGT145 to trimeric BG505 SOSIP.664

| Analyte | Capture antibody | $R_{max}$ (± SE) (RU)‡ | Level of trimer capture (± SD) (RU) (n=6)† | Normalized $R_{max}$ (RU)# | Stoichiometry |
|---|---|---|---|---|---|
| 35O22 | 2G12 | 124.7 ± 0.17 | 491.02 ± 3.33 | 25.4 | $3^{13}$ |
|  | CD4 Ig | 77.4 ± 0.091 | 408.05 ± 2.15 | 19.0 | 2.2 (this study) |
| PGT151 | 2G12 | 92.6 ± 0.28 | 486.73 ± 0.19 | 19.0 | $2^{27}$ |
|  | CD4 Ig | 18.1 ± 0.06 | 447.08 ± 2.97 | 4.0 | <1 (this study) |
| PGT145 | 2G12 | 32.6 ± 0.44 | 483.56 ± 6 | 6.74 | $1^{62}$ |

FIG. 17

| | Neut. mAb | Method | New Res. | Sum total | PDB ID |
|---|---|---|---|---|---|
| HIV-1 Env gp120 (31, 311-316; 319-321, 511) / gp41 (512, 683) | 50.1 | X-ray | 9 | 9 | 1GGI |
| 90-129, 194, 299, 329, 396, 410, 492 | 17b | X-ray | 297 | 306 | 1GC1 |
| | 58.2 | X-ray | 4 | 310 | 1F58 |
| 317-318; 326-328 | 0.5b | NMR | 5 | 315 | 1B03 |
| 662-668 | 2F5 | X-ray | 7 | 322 | 2F5B |
| 657-661; 669-670 | 2F5 | X-ray | 7 | 329 | 1TJI |
| 671-680 | 4E10 | X-ray | 10 | 339 | 1TZG |
| 84-89, 130, 300-309, 397; 401-409 (V3) | X5 | X-ray | 27 | 366 | 2B4C |
| 543-582, 626-656 | D5 | X-ray | 71# | 366 | 2CMR |
| 681-683 | 4E10 | X-ray | 3 | 369 | 2FX7 |
| 31, 83, 398-400, 493-501 | 48d | X-ray | 65 | 434 | 3JWD |
| 131-132; 153-178; 190-193 (V1V2) | PG9 | X-ray | 32 | 466 | 3U2S |
| 656 | 10E8 | X-ray | 1 | 467 | 4G6F |
| Trimeric, HR1, HR2 | VRC03 | Cryo-EM | 31* | 467 | 4CC8 |
| Trimeric, 133-145; 149-152, 310 | PGT122 PGV04 | X-ray Cryo-EM | 18 + 77* | 485 | 4NCO 3J5M |
| Trimeric, 146-148; 179-185; 187-189, 502-505, 58-547; 569, 655 | PGT122 & 35022 | X-ray | 134 | 619 | |

FIG. 18A
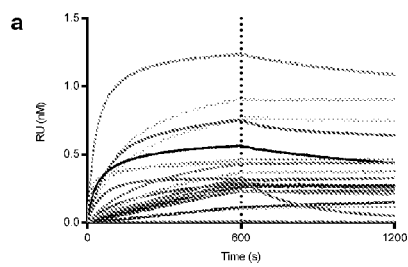
FIG. 18A
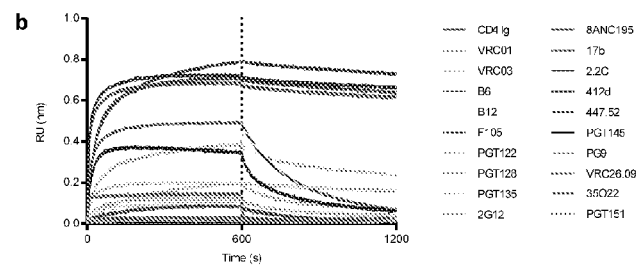
FIG. 18C
| Epitope | Antibody | BG505 SOSIP.664 | BG505 gp120 | BG505 SOSIP.664 Published ELISA results ( + or - ) |
|---|---|---|---|---|
| CD4bs | CD4 Ig | ++ | +++ | + |
| | VRC01 | ++ | ++ | + |
| | VRC03 | +++ | + | + |
| | b6 | ++ | +++ | + |
| | b12 | + | ++ | - |
| | F105 | - | ++ | - |
| Glycan-V3 | PGT122 | + | + | + |
| | PGT128 | ++ | + | + |
| OD-glycan | PGT135 | +++ | - | + |
| | 2G12 | ++ | + | + |
| 8ANC195 site | 8ANC195 | ++ | + | + |
| CD4i | 17b | + | +++ | - |
| | 2.2C | + | +++ | nd |
| | 412d | ++ | ++ | - |
| V1/V2 glycan | PG9 | + | - | + |
| | PGT145 | +++ | - | + |
| | VRC26.09 | ++ | - | nd |
| Quaternary gp120/gp41 | 35O22 | ++ | - | nd |
| | PGT151 | +++ | - | nd |

FIG. 20C

Binding Residues of Fusion-Intermediate Entry Inhibitors
Mapped onto Pre-Fusion Envelope Entry Inhibitors Docked onto Fusion-Intermediate FIG. 23
BG505 SOSIP.664 captured with 2G12 IgG
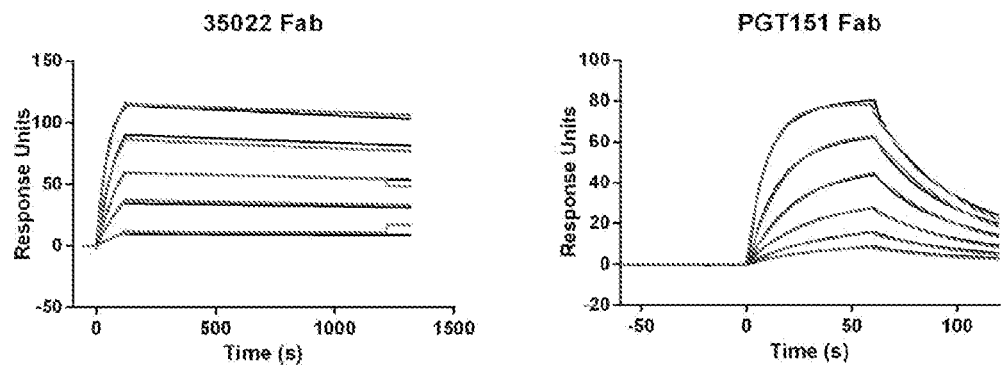
BG505 SOSIP.664 captured with CD4-Ig
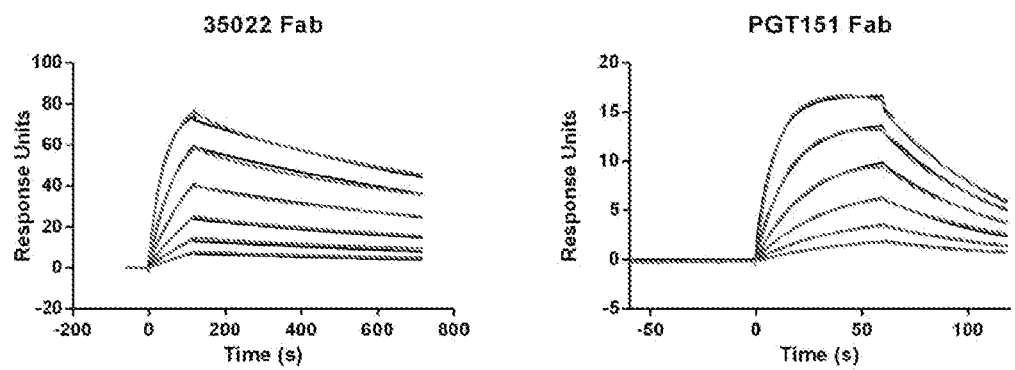
BG505 SOSIP.664 (+sCD4) captured with 17b
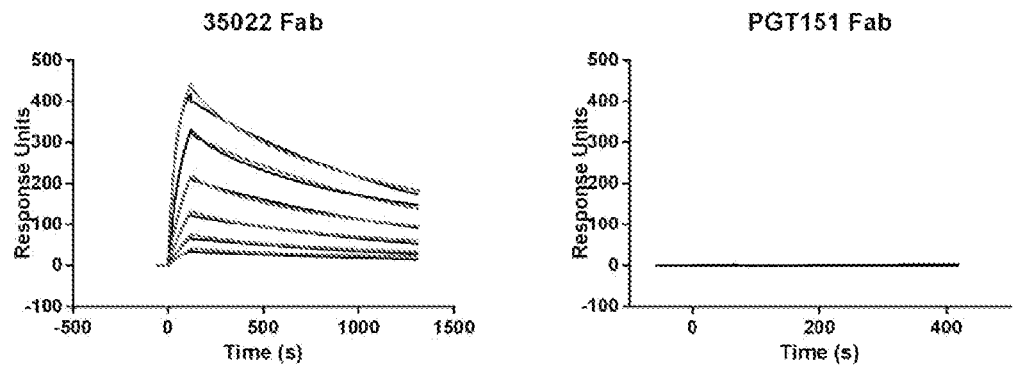

FIG. 25A gp120-gp41 interface within the same protomer.

| \multicolumn{7}{c}{Disulfide bond, Hydrogen bonds and salt bridges} |
|---|---|---|---|---|---|---|
| Type | gp120 | Dist.[Å] | gp41 | Type | gp120 | Dist.[Å] | gp41 |
| D* | G:CYS501[SG] | 2.03 | B:CYS605[SG] | H | G:VAL36[O] | 3.44 | B:THR606[N] |
| H | G:VAL36[N] | 3.23 | B:VAL608[O] | H | G:VAL38[O] | 3.44 | B:CYS604[N] |
| H | G:VAL38[N] | 3.23 | B:CYS604[O] | H | G:GLY41[O] | 2.85 | B:GLN540[NE2] |
| H | G:TYR40[N] | 2.78 | B:LEU602[O] | H | G:ILE491[O] | 2.47 | B:ARG585[NH2] |
| H | G:GLY222[N] | 3.32 | B:LEU544[O] | H | G:LEU494[O] | 3.69 | B:TYR643[OH] |
| H | G:CYS501[SG] | 2.03 | B:CYS605[SG] | H | G:VAL496[O] | 3.01 | B:TRP631[NE1] |
| H | G:ARG503[N] | 3.69 | B:ASN607[OD1] | H | G:PRO498[O] | 3.22 | B:TRP623[NE1] |
| H | G:ARG503[NE] | 2.77 | B:CYS605[O] | S | G:ARG503[NH1] | 3.66 | B:GLU654[OE1] |
| H | G:ARG503[NH1] | 3.66 | B:GLU654[OE1] | S | G:ARG503[NH1] | 3.77 | B:GLU654[OE2] |
| H | G:ARG503[NH2] | 3.88 | B:ASN651[OD1] | S | G:ARG503[NH2] | 3.31 | B:GLU654[OE2] |
| H | G:ARG503[NH2] | 3.31 | B:GLU654[OE2] | S | G:ASP107[OD1] | 3.88 | B:LYS574[NZ] |
| H | G:LEU34[O] | 3.27 | B:TRP610[N] | | | | |

FIG. 25B gp120-gp41 interface within the same protomer.

List of interface residues (the residues on each row are not matched interactive partners)

| gp120 | HSD* | ASA | BSA | ΔiG | gp41 | HSD | ASA | BSA | ΔiG |
|---|---|---|---|---|---|---|---|---|---|
| G:GLU32 |  | 159.45 | 4.30\| | -0.05 | B:LEU520 |  | 121.69 | 21.75\|\| | -0.12 |
| G:ASN33 |  | 89.08 | 2.66\| | 0.01 | B:GLY521 |  | 26.76 | 8.18\|\|\| | 0.13 |
| G:LEU34 | H | 110.93 | 77.87\|\|\|\|\|\|\|\| | 0.76 | B:PHE522 |  | 97.67 | 71.75\|\|\|\|\|\|\|\| | 0.51 |
| G:TRP35 |  | 100.83 | 63.15\|\|\|\|\|\| | 1.01 | B:LEU523 |  | 109.67 | 109.67\|\|\|\|\|\|\|\|\|\| | 1.53 |
| G:VAL36 | H | 114.66 | 114.66\|\|\|\|\|\|\|\|\|\| | 1.46 | B:GLY524 |  | 27.66 | 25.36\|\|\|\|\|\|\|\|\| | -0.07 |
| G:THR37 |  | 30.75 | 25.23\|\|\|\|\|\|\|\| | 0.40 | B:ALA525 |  | 10.37 | 5.95\|\|\|\| | 0.03 |
| G:VAL38 | H | 106.47 | 104.98\|\|\|\|\|\|\|\|\|\| | 0.87 | B:ALA526 |  | 41.11 | 39.96\|\|\|\|\|\|\|\|\| | 0.64 |
| G:TYR39 |  | 105.81 | 81.77\|\|\|\|\|\|\|\| | 1.01 | B:GLY527 |  | 69.79 | 56.29\|\|\|\|\|\|\|\|\| | 0.37 |
| G:TYR40 | H | 179.40 | 176.84\|\|\|\|\|\|\|\|\|\| | 0.80 | B:SER528 |  | 36.71 | 6.97\|\| | 0.02 |
| G:GLY41 | H | 56.83 | 56.83\|\|\|\|\|\|\|\|\|\| | 0.14 | B:MET530 |  | 4.02 | 4.02\|\|\|\|\|\|\|\|\|\| | 0.06 |
| G:VAL42 |  | 35.68 | 35.68\|\|\|\|\|\|\|\|\|\| | 0.53 | B:ALA533 |  | 9.35 | 9.35\|\|\|\|\|\|\|\|\|\| | 0.10 |
| G:PRO43 |  | 120.19 | 120.19\|\|\|\|\|\|\|\|\|\| | 1.42 | B:SER534 |  | 34.69 | 8.52\|\|\| | 0.07 |
| G:VAL44 |  | 65.52 | 61.67\|\|\|\|\|\|\|\|\| | 0.99 | B:THR536 |  | 14.87 | 0.67\| | 0.01 |
| G:TRP45 |  | 54.65 | 44.97\|\|\|\|\|\|\|\| | 0.41 | B:LEU537 |  | 55.20 | 46.56\|\|\|\|\|\|\|\|\| | 0.64 |
| G:LYS46 |  | 120.67 | 43.68\|\|\|\| | -0.47 | B:GLN540 | H | 43.31 | 43.31\|\|\|\|\|\|\|\|\|\| | 0.39 |
| G:THR50 |  | 25.14 | 5.03\|\|\| | -0.06 | B:ALA541 |  | 51.42 | 26.04\|\|\|\|\| | 0.38 |
| G:THR51 |  | 113.45 | 69.78\|\|\|\|\|\|\|\| | 0.90 | B:ASN543 |  | 67.50 | 4.04\| | -0.05 |
| G:LEU52 |  | 17.22 | 12.82\|\|\|\|\|\|\|\| | -0.13 | B:LEU544 | H | 101.31 | 92.14\|\|\|\|\|\|\|\|\| | 0.99 |
| G:PHE53 |  | 85.28 | 39.95\|\|\|\|\| | 0.64 | B:LEU545 |  | 73.00 | 8.28\|\| | -0.06 |
| G:CYS54 |  | 42.46 | 32.07\|\|\|\|\|\|\|\| | 0.95 | B:SER546 |  | 84.70 | 8.33\| | 0.08 |
| G:ALA70 |  | 37.95 | 31.06\|\|\|\|\|\|\|\|\| | 0.24 | B:THR569 |  | 176.82 | 10.29\| | 0.01 |
| G:THR71 |  | 14.13 | 1.57\|\| | 0.00 | B:VAL570 |  | 125.76 | 35.73\|\|\| | 0.57 |
| G:HIS72 |  | 121.47 | 5.88\| | 0.06 | B:TRP571 |  | 220.73 | 156.50\|\|\|\|\|\|\|\|\| | 1.92 |
| G:ALA73 |  | 96.56 | 29.12\|\|\|\| | 0.24 | B:GLY572 |  | 37.57 | 18.36\|\|\|\|\| | 0.29 |
| G:CYS74 |  | 23.63 | 7.73\|\|\| | 0.17 | B:LYS574 | S | 152.09 | 82.95\|\|\|\|\| | 0.70 |
| G:VAL75 |  | 78.47 | 11.55\|\| | 0.18 | B:GLN575 |  | 92.61 | 41.82\|\|\|\|\| | 0.67 |
| G:ILE84 |  | 99.58 | 66.43\|\|\|\|\|\|\| | 1.06 | B:GLN577 |  | 134.10 | 6.02\| | 0.10 |
| G:HIS85 |  | 78.96 | 1.35\| | -0.02 | B:ALA578 |  | 57.70 | 53.73\|\|\|\|\|\|\|\|\|\| | 0.71 |
| G:LEU86 |  | 30.31 | 29.33\|\|\|\|\|\|\|\|\|\| | 0.47 | B:ARG579 |  | 151.60 | 3.66\| | 0.05 |
| G:GLU87 |  | 119.82 | 18.20\|\| | -0.05 | B:LEU581 |  | 110.03 | 27.96\|\|\| | 0.45 |
| G:ASN88 |  | 153.77 | 33.19\|\|\| | 0.03 | B:ALA582 |  | 40.33 | 33.52\|\|\|\|\|\|\|\|\| | 0.50 |
| G:VAL89 |  | 37.55 | 31.55\|\|\|\|\|\|\|\|\| | 0.50 | B:ARG585 | H | 143.40 | 111.70\|\|\|\|\|\|\|\|\|\| | -1.49 |
| G:GLU91 |  | 30.92 | 4.37\|\| | -0.07 | B:TYR586 |  | 44.47 | 4.86\|\| | 0.07 |
| G:GLN103 |  | 36.99 | 3.93\|\| | 0.03 | B:ARG588 |  | 110.32 | 8.29\| | -0.25 |
| G:THR106 |  | 80.82 | 1.23\| | -0.01 | B:ASP589 |  | 57.71 | 54.89\|\|\|\|\|\|\|\|\| | 0.08 |
| G:ASP107 | S | 61.19 | 45.56\|\|\|\|\|\|\|\| | -0.27 | B:GLN590 |  | 43.04 | 13.39\|\|\|\| | -0.15 |
| G:SER110 |  | 55.55 | 0.37\| | -0.00 | B:LEU592 |  | 49.31 | 7.70\|\| | 0.12 |
| G:LEU111 |  | 27.14 | 6.17\|\|\| | 0.10 | B:LEU593 |  | 45.47 | 42.80\|\|\|\|\|\|\|\|\|\| | 0.68 |
| G:GLN114 |  | 120.33 | 31.88\|\|\| | -0.10 | B:TRP596 |  | 31.12 | 29.58\|\|\|\|\|\|\|\|\|\| | 0.47 |
| G:ILE215 |  | 13.89 | 7.54\|\|\|\|\| | 0.12 | B:GLY597 |  | 27.87 | 21.33\|\|\|\|\|\|\|\| | 0.10 |
| G:PRO220 |  | 41.14 | 34.13\|\|\|\|\|\|\|\|\| | 0.55 | B:CYS598 |  | 28.15 | 7.27\|\|\| | 0.30 |
| G:ALA221 |  | 100.15 | 84.00\|\|\|\|\|\|\|\|\| | 0.92 | B:LYS601 |  | 100.71 | 9.72\| | 0.16 |
| G:GLY222 | H | 45.99 | 42.17\|\|\|\|\|\|\|\|\|\| | 0.36 | B:LEU602 | H | 109.20 | 36.90\|\|\|\| | -0.19 |
| G:PHE223 |  | 53.56 | 40.21\|\|\|\|\|\|\|\| | 0.53 | B:ILE603 |  | 132.63 | 27.62\|\|\| | 0.44 |
| G:ALA224 |  | 16.56 | 15.06\|\|\|\|\|\|\|\|\|\| | 0.24 | B:CYS604 | H | 51.21 | 33.54\|\|\|\|\|\| | 0.02 |
| G:LEU226 |  | 2.85 | 2.85\|\|\|\|\|\|\|\|\|\| | 0.05 | B:CYS605 | HD | 122.91 | 92.60\|\|\|\|\|\|\|\| | 2.38 |

FIG. 25C gp120-gp41 interface within the same protomer.

| gp120 | HSD* | ASA | BSA | ΔiG | gp41 | HSD | ASA | BSA | ΔiG |
|---|---|---|---|---|---|---|---|---|---|
| G:THR244 |  | 24.69 | 21.63 | 0.25 | B:THR606 | H | 50.11 | 49.65 | -0.26 |
| G:GLN246 |  | 85.27 | 1.22 | -0.02 | B:ASN607 | H | 124.12 | 79.55 | -0.46 |
| G:VAL489 |  | 0.34 | 0.34 | 0.01 | B:VAL608 | H | 37.64 | 31.45 | -0.08 |
| G:LYS490 |  | 73.37 | 17.59 | 0.25 | B:PRO609 |  | 117.67 | 28.85 | 0.45 |
| G:ILE491 | H | 61.56 | 61.56 | 0.58 | B:TRP610 | H | 120.54 | 93.20 | 1.27 |
| G:GLU492 |  | 66.22 | 16.94 | 0.16 | B:TRP614 |  | 17.78 | 1.72 | 0.03 |
| G:PRO493 |  | 36.83 | 35.49 | 0.57 | B:ARG617 |  | 120.66 | 11.78 | -0.13 |
| G:LEU494 | H | 126.36 | 110.93 | 1.37 | B:ASN618 |  | 90.29 | 5.61 | -0.03 |
| G:GLY495 |  | 22.28 | 16.59 | 0.26 | B:LEU619 |  | 122.62 | 80.84 | 1.19 |
| G:VAL496 | H | 111.77 | 105.32 | 1.09 | B:ILE622 |  | 19.73 | 18.90 | 0.30 |
| G:ALA497 |  | 40.47 | 40.47 | 0.64 | B:TRP623 | H | 88.48 | 63.25 | 0.83 |
| G:PRO498 | H | 85.23 | 85.23 | 0.85 | B:TRP628 |  | 104.58 | 102.71 | 1.60 |
| G:THR499 |  | 44.62 | 19.72 | 0.20 | B:LEU629 |  | 134.49 | 88.15 | 1.41 |
| G:ARG500 |  | 189.46 | 32.79 | -0.35 | B:TRP631 | H | 28.70 | 24.25 | -0.01 |
| G:CYS501 | HD | 74.02 | 24.28 | 0.81 | B:ASP632 |  | 83.43 | 62.02 | -0.30 |
| G:LYS502 |  | 140.46 | 28.75 | 0.46 | B:LYS633 |  | 159.78 | 16.90 | 0.27 |
| G:ARG503 | HS | 206.15 | 158.06 | -1.47 | B:ILE635 |  | 7.69 | 5.85 | 0.09 |
| G:ARG504 |  | 207.48 | 14.46 | -0.16 | B:SER636 |  | 54.68 | 6.70 | 0.11 |
| G:VAL505 |  | 195.08 | 15.78 | 0.23 | B:THR639 |  | 37.06 | 7.68 | 0.12 |
|  |  |  |  |  | B:ILE642 |  | 28.01 | 28.01 | 0.45 |
|  |  |  |  |  | B:TYR643 | H | 80.82 | 41.37 | -0.04 |
|  |  |  |  |  | B:LEU646 |  | 21.93 | 21.76 | 0.35 |
|  |  |  |  |  | B:GLN650 |  | 19.52 | 1.36 | -0.01 |
|  |  |  |  |  | B:ASN651 | H | 21.14 | 1.12 | -0.01 |
|  |  |  |  |  | B:GLU654 | HS | 92.77 | 24.69 | -0.32 |
|  |  |  |  |  | B:LEU661 |  | 124.01 | 16.57 | 0.27 |

Glycan-peptide interactions (interactive partners are shaded)

| gp120 | HSD* | ASA | BSA | ΔiG | gp41 | HSD | ASA | BSA | ΔiG |
|---|---|---|---|---|---|---|---|---|---|
| G:NAG1088 | H | 361.66 | 73.01 | -1.75 | B:LEU520 |  | 121.69 | 16.40 | 0.26 |
|  |  |  |  |  | B:GLY524 |  | 27.66 | 1.84 | -0.02 |
|  |  |  |  |  | B:GLY527 |  | 69.79 | 11.56 | 0.01 |
|  |  |  |  |  | B:SER528 | H | 36.71 | 27.04 | -0.12 |
| G:NAG1089 |  | 351.65 | 3.07 | -0.04 | B:THR529 |  | 40.42 | 0.86 | -0.01 |
|  |  |  |  |  | B:ALA532 |  | 46.96 | 2.35 | 0.04 |
| G:GLU32 |  | 159.45 | 39.08 | -0.38 | B:NAG1618 |  | 364.26 | 36.79 | -0.53 |
| G:ARG500 |  | 189.46 | 4.52 | -0.05 |  |  |  |  |  |

FIG. 25D gp41-gp41 interface between two protomers.

| Type | Protomer 1 | Dist.[Å] | Protomer 2 | Type | Protomer 1 | Dist.[Å] | Protomer 2 |
|---|---|---|---|---|---|---|---|
| H* | B:THR538[N] | 3.25 | N:GLN652[OE1] | H | B:ARG542[O] | 3.70 | N:GLN591[NE2] |
| H | B:THR538[OG1] | 3.34 | N:GLU647[O] | H | B:LYS601[O] | 2.99 | N:LYS655[NZ] |
| H | B:ARG579[NH2] | 3.66 | N:GLN577[O] | S | B:ARG579[NE] | 3.91 | N:GLU584[OE1] |
| H | B:SER534[O] | 3.04 | N:GLN652[NE2] | S | B:ARG579[NE] | 3.81 | N:GLU584[OE2] |
| H | B:MET535[SD] | 3.18 | N:ASN656[ND2] | S | B:ARG579[NH1] | 3.66 | N:GLU584[OE1] |
| H | B:ALA541[O] | 2.60 | N:GLN591[NE2] | | | | |

List of interface residues (the residues on each row are not matched interactive partners)

| Protomer 1 | HSD* | ASA | BSA | ΔiG | Protomer 2 | HSD | ASA | BSA | ΔiG |
|---|---|---|---|---|---|---|---|---|---|
| B:PHE519 | | 186.83 | 42.66||| | 0.68 | N:VAL570 | | 126.21 | 2.34| | 0.04 |
| B:SER534 | H | 34.69 | 13.07|||| | -0.07 | N:ILE573 | | 93.94 | 22.94||| | 0.37 |
| B:MET535 | H | 156.91 | 40.14||| | 0.81 | N:LEU576 | | 82.58 | 20.67||| | 0.33 |
| B:LEU537 | | 55.20 | 6.31|| | 0.09 | N:GLN577 | H | 134.57 | 53.69|||| | 0.09 |
| B:THR538 | H | 75.83 | 69.24|||||||| | 0.30 | N:VAL580 | | 67.81 | 44.79|||||| | 0.72 |
| B:ALA541 | H | 51.42 | 23.75||||| | 0.04 | N:LEU581 | | 110.02 | 15.40|| | 0.25 |
| B:ARG542 | H | 146.72 | 59.48||||| | 0.51 | N:VAL583 | | 66.78 | 10.55|| | 0.17 |
| B:LEU545 | | 73.00 | 56.46|||||||| | 0.90 | N:GLU584 | S | 106.22 | 87.36|||||||| | -0.21 |
| B:SER546 | | 84.70 | 0.73| | -0.01 | N:ARG585 | | 143.08 | 0.17| | 0.00 |
| B:GLY547 | | 117.72 | 55.99||||| | 0.31 | N:LEU587 | | 110.12 | 85.18|||||| | 1.31 |

| Protomer 1 | HSD* | ASA | BSA | ΔiG | Protomer 2 | HSD | ASA | BSA | ΔiG |
|---|---|---|---|---|---|---|---|---|---|
| B:THR569 | | 176.82 | 2.47| | -0.03 | N:ARG588 | | 110.89 | 34.82|||| | 0.55 |
| B:GLY572 | | 37.57 | 0.61| | -0.01 | N:GLN590 | | 42.98 | 2.39| | -0.02 |
| B:ILE573 | | 94.88 | 15.39|| | 0.25 | N:GLN591 | H | 117.50 | 107.20||||||||| | -0.48 |
| B:GLN575 | | 92.61 | 12.96|| | -0.15 | N:LEU592 | | 48.64 | 3.52| | 0.06 |
| B:LEU576 | | 83.59 | 62.75|||||||| | 1.00 | N:GLY594 | | 29.76 | 21.20|||||| | 0.21 |
| B:ARG579 | HS | 151.60 | 91.09|||||| | -0.97 | N:ILE595 | | 63.30 | 59.10|||||||| | 0.89 |
| B:VAL580 | | 68.80 | 23.47|||| | 0.38 | N:SER599 | | 77.41 | 18.41||| | -0.01 |
| B:VAL583 | | 66.76 | 51.19|||||||| | 0.82 | N:GLU647 | H | 69.63 | 48.68|||||| | -0.26 |
| B:TYR586 | | 44.47 | 28.29|||||| | 0.11 | N:GLU648 | | 126.06 | 52.30|||| | 0.16 |
| B:LEU587 | | 110.38 | 25.61||| | 0.41 | N:ASN651 | | 20.57 | 11.32||||| | 0.05 |
| B:SER599 | | 76.87 | 6.95| | -0.05 | N:GLN652 | H | 118.71 | 94.27|||||| | -0.62 |
| B:GLY600 | | 48.68 | 17.81|||| | 0.29 | N:LYS655 | H | 119.03 | 86.36||||||| | -0.78 |
| B:LYS601 | H | 100.71 | 68.22|||||| | -0.56 | N:ASN656 | H | 84.63 | 43.02||||| | -0.41 |
| B:LEU602 | | 109.20 | 68.18|||||| | 1.09 | N:GLN658 | | 112.11 | 4.37| | 0.02 |
| B:ILE603 | | 132.63 | 71.19||||| | 1.04 | N:ASP659 | | 92.31 | 28.16|||| | -0.10 |
| B:CYS605 | | 122.91 | 30.32||| | 1.24 | N:ALA662 | | 81.10 | 14.85|| | 0.24 |

FIG. 25E gp120-gp120 interface between two protomers.

| Hydrogen bonds | | | | | | | |
|---|---|---|---|---|---|---|---|
| Type | Protomer 1 | Dist.[Å] | Protomer 2 | Type | Protomer 1 | Dist.[Å] | Protomer 2 |
| H* | G:ARG166[N] | 3.53 | M:CYS126[O] | H | G:ARG308[NH2] | 2.51 | M:ASN197[O] |
| H | G:ARG166[NH1] | 3.12 | M:THR162[OG1] | H | G:ASP167[OD1] | 2.82 | M:THR128[N] |

List of interface residues (the residues on each row are not matched interactive partners)

| Protomer 1 | HSD* | ASA | BSA | ΔiG | Protomer 2 | HSD | ASA | BSA | ΔiG |
|---|---|---|---|---|---|---|---|---|---|
| G:LYS121 |   | 125.83 | 1.05| | -0.04 | M:LYS121 |   | 124.12 | 1.05| | -0.04 |
| G:GLU164 |   | 60.11 | 32.69||||| | 0.27 | M:THR123 |   | 86.16 | 17.50||| | 0.04 |
| G:LEU165 |   | 121.56 | 88.67|||||| | 1.42 | M:PRO124 |   | 50.39 | 29.08||||| | 0.47 |
| G:ARG166 | H | 232.85 | 96.11||||| | 0.02 | M:CYS126 | H | 58.84 | 57.67|||||||| | 0.69 |
| G:ASP167 | H | 112.65 | 53.43||||| | -0.30 | M:VAL127 |   | 50.15 | 40.17|||||||| | 0.64 |
| G:LYS168 |   | 169.18 | 6.94| | 0.03 | M:THR128 | H | 84.95 | 48.41||||| | 0.61 |
| G:ARG308 | H | 154.00 | 41.66||| | -0.61 | M:ASN160 |   | 66.98 | 1.80| | -0.01 |
| G:PRO313 |   | 113.91 | 95.17|||||||| | 1.22 | M:THR162 | H | 61.82 | 28.15||||| | -0.17 |
| G:GLY314 |   | 80.10 | 34.53||||| | 0.35 | M:ILE184 |   | 86.42 | 10.72|| | 0.17 |
| G:GLN315 |   | 69.99 | 5.43| | -0.06 | M:GLU190 |   | 65.42 | 1.60| | -0.05 |
|   |   |   |   |   | M:TYR191 |   | 11.33 | 0.24| | -0.00 |
|   |   |   |   |   | M:ARG192 |   | 53.70 | 22.11||||| | 0.35 |
|   |   |   |   |   | M:CYS196 |   | 37.27 | 36.90|||||||| | -0.17 |
|   |   |   |   |   | M:ASN197 | H | 100.94 | 44.59||||| | 0.18 |
|   |   |   |   |   | M:THR198 |   | 75.16 | 6.04| | -0.02 |
|   |   |   |   |   | M:SER199 |   | 23.86 | 21.46|||||||| | 0.23 |
|   |   |   |   |   | M:ALA200 |   | 72.04 | 35.32||||| | 0.43 |
|   |   |   |   |   | M:ILE201 |   | 6.81 | 1.97||| | 0.02 |

| Glycan-peptide interactions (interactive partners are shaded) | | | | | | | |
|---|---|---|---|---|---|---|---|
| Protomer 1 | HSD* | ASA | BSA | ΔiG | Protomer 2 | HSD | ASA | BSA | ΔiG |
| G:ASP167 |   | 112.65 | 11.41|| | -0.19 | M:NAG1160 |   | 357.88 | 10.91| | -0.36 |
| G:ARG308 |   | 154.00 | 36.82||| | -0.89 | M:NAG1197 |   | 357.46 | 36.02|| | -1.02 | gp120-gp41 interface between two protomers.

List of interface residues (the residues on each row are not matched interactive partners)

| Protomer 1 | HSD* | ASA | BSA | ΔiG | Protomer 2 | HSD | ASA | BSA | ΔiG |
|---|---|---|---|---|---|---|---|---|---|
| G:ALA31 |   | 96.84 | 2.91| | -0.00 | N:GLN591 |   | 117.50 | 1.89| | -0.02 |
| G:THR37 |   | 30.75 | 3.85|| | 0.06 | N:GLN658 |   | 112.11 | 21.55|| | -0.25 |
| G:TYR39 |   | 105.81 | 8.33| | -0.10 | N:ASP659 |   | 92.31 | 47.80||||| | -0.54 |
| G:TYR40 |   | 179.40 | 2.13| | -0.00 | N:ALA662 |   | 81.10 | 39.46||||| | 0.21 |
| G:THR499 |   | 44.62 | 12.18||| | 0.00 | N:LEU663 |   | 135.17 | 73.02||||| | 0.91 |
| G:ARG500 |   | 189.46 | 55.45||| | -0.49 |   |   |   |   |   |
| G:CYS501 |   | 74.02 | 49.74|||||| | 1.65 |   |   |   |   |   |

| Protomer 1 | HSD* | ASA | BSA | ΔiG | Protomer 2 | HSD | ASA | BSA | ΔiG |
|---|---|---|---|---|---|---|---|---|---|
| G:LYS502 |   | 140.46 | 19.36|| | -0.22 |   |   |   |   |   |
| G:ARG503 |   | 206.15 | 0.17| | 0.00 |   |   |   |   |   |
| G:ARG504 |   | 207.48 | 22.43|| | -0.52 |   |   |   |   |   |

FIG. 26

| Target | Chain | Z | rmsd | lali | nres | %id PDB | Description |
|---|---|---|---|---|---|---|---|
| gp41 monomer | 3FF6-D | 3 | 4.9 | 74 | 733 | 9 PDB | ACETYL-COA CARBOXYLASE 2 |
| | 4JLE-B | 2.6 | 8.1 | 66 | 159 | 6 PDB | PHIST |
| | 4B4C-A | 2.3 | 4.1 | 66 | 187 | 6 PDB | CHROMODOMAIN-HELICASE-DNA-BINDING |
| gp41+gp120 N and C (monomer) | 4B4C-A | 2.1 | 3.8 | 66 | 187 | 6 PDB | CHROMODOMAIN-HELICASE-DNA-BINDING |
| | 3GTY-X | 2 | 6.3 | 89 | 412 | 7 PDB | TRIGGER FACTOR |
| gp41+gp120 N and C (trimer) | 1QOY-A | 2.6 | 4.5 | 114 | 303 | 6 PDB | HEMOLYSIN E |
| | 3ZYM-C | 2.5 | 5.1 | 110 | 280 | 7 PDB | PHOSPHATIDYLINOSITOL-BINDING CLATHRIN ASSEMBLY |
| | 1HX8-A | 2.1 | 9 | 104 | 270 | 8 PDB | SYNAPSE-ENRICHED CLATHRIN ADAPTOR PROTEIN LAP |
| | 3ZYK-A | 2 | 4.5 | 109 | 269 | 5 PDB | PHOSPHATIDYLINOSITOL-BINDING CLATHRIN ASSEMBLY |

Target: gp41

Target: gp41+gp120 N and C

Target: gp41+gp120 N and C (Trimer)

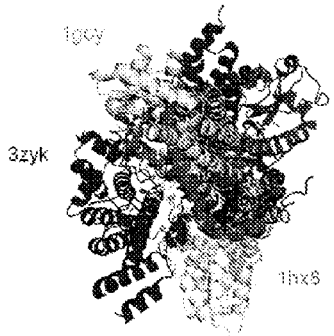

FIG. 27A

Conformational States of HIV-1 Envelope

| Subunit | Site | Antibody | Uncleaved | Prefusion mature closed state | Prefusion partially open Intermediate | Prefusion receptor-bound open intermediate | Postfusion |
|---|---|---|---|---|---|---|---|
| gp120 | CD4 binding site | | | | | | |
| | *Neutralizing* | VRC01-class, 8ANC131 class, CH103 | — | — | — | — | |
| | *Non-neutralizing* | F105, b13 | — | | | — | |
| | V1V2 region | | | | | | |
| | *quaternary specific, neutralizing* | VRC26, PGT145 | — | — | | | |
| | *quaternary preferring, neutralizing* | PG9, PG16, CH01-04 | — | — | | | |
| | *Non-neutralizing* | CH58, CH59 | — | — | | | |
| | V3 loop | | | | | | |
| | *Non-neutralizing* | 447-52D, 39F | — | | | — | |
| | *Neutralizing* | PGT128, PGT121, PGT135 | — | — | — | — | |
| | Co-receptor binding site | | | | | | |
| | *Non-neutralizing* | 17b, 48d, 412d, X5 | — | | | — | — |
| | gp41 interactive region | | | | | | |
| | *Non-neutralizing* | A32, N5_i5, C11, N12_i3 | — | | | — | — |

FIG. 27B

Conformational States of HIV-1 Envelope

| Subunit | Site | Antibody | Uncleaved | Prefusion mature closed state | Prefusion partially open Intermediate | Prefusion receptor-bound open intermediate | Postfusion |
|---|---|---|---|---|---|---|---|
| gp41 | Cluster I (~aa 579-613) Non-Neutralizing | 50-69, 240D, 1367, 7B2, F240 | ▬▬▬ | | | | ▭ |
| | Cluster II (~aa 644-667) Non-Neutralizing | 98-6, 126-6, 167-D, 1379, 1281 | ▬▬▬ | | | | ▭ |
| | HR-1 (~aa 564-579) Neutralizing | D5, 8066, HK20 | | | | ▭ | |
| | MPER (~aa 656 to 683) Neutralizing | 2F5, 4E10, 10E8 | ▭ | | | ▭ | ▬▬▬ |
| | Non-Neutralizing | 13H11 | ⋯ | | | | |
| gp120/gp41 | Quaternary Specific | 39O22 | | ▬▬▬ | | | |
| | | PGT151 | | ▬▬▬ | | | |

FIG. 28A

35O22 heavy chain (chain D) and light chain (chain E) interface with gp41 (chain B)

| | | | Hydrogen bonds | | | | |
|---|---|---|---|---|---|---|---|
| | gp41 | Dist.[Å] | 35O22 | | gp41 | Dist.[Å] | 35O22 |
| 1 | B:ASN625[ND2] | 3.68 | D:LEU96[O] | 3 | B:ASP624[O] | 3.04 | D:ARG98[N] |
| 2 | B:ASN625[OD1] | 2.44 | D:TYR32[OH] | 4 | B:ASP624[O] | 3.20 | D:ASP99[N] |

List of heavy chain-gp41 interface residues (the residues on each row are not matched interactive partners)

| gp41 | HSD* | ASA | BSA | ΔiG | 35O22 | HSD | ASA | BSA | ΔiG |
|---|---|---|---|---|---|---|---|---|---|
| B:GLY527 | | 69.79 | 18.98||| | -0.13 | D:GLN1 | | 192.89 | 29.65|| | -0.35 |
| B:SER528 | | 36.71 | 4.59|| | 0.07 | D:PHE31 | | 63.18 | 12.09|| | 0.19 |
| B:THR529 | | 40.42 | 37.31|||||||||| | 0.24 | D:TYR32 | H | 53.73 | 25.90||||| | -0.26 |
| B:ALA532 | | 46.96 | 3.52| | 0.06 | D:PHE72H | | 169.27 | 95.44||||| | 1.53 |
| B:ARG617 | | 120.66 | 26.65||| | -0.70 | D:LEU96 | H | 56.05 | 5.65|| | -0.06 |
| B:SER620 | | 73.21 | 21.28||| | -0.18 | D:LEU97 | | 90.59 | 68.55||||||| | 1.10 |
| B:GLU621 | | 86.31 | 8.52| | 0.14 | D:ARG98 | H | 153.80 | 71.96||||| | -0.38 |
| B:ASP624 | H | 98.64 | 66.75|||||| | -0.11 | D:ASP99 | H | 118.53 | 47.77||||| | 0.22 |
| B:ASN625 | H | 112.81 | 73.74|||||| | -0.54 | D:GLY100 | | 52.83 | 5.97|| | 0.10 |
| B:MET626 | | 7.75 | 2.28||| | 0.02 | | | | | |
| B:THR627 | | 29.84 | 21.28|||||||| | 0.24 | | | | | |
| B:LEU629 | | 134.49 | 18.20|| | 0.21 | | | | | |
| B:GLN630 | | 99.10 | 36.41|||| | 0.35 | | | | | |

List of light chain-gp41 interface residues (the residues on each row are not matched interactive partners)

| gp41 | HSD | ASA | BSA | ΔiG | 35O22 | HSD | ASA | BSA | ΔiG |
|---|---|---|---|---|---|---|---|---|---|
| B:LYS633 | | 159.78 | 17.24|| | -0.05 | E:TYR49 | | 74.12 | 32.70||||| | -0.26 |
| B:ARG617 | | 120.66 | 2.47| | -0.09 | E:GLU50 | | 85.57 | 7.34| | -0.10 |
| B:ASN618 | | 90.29 | 18.66||| | -0.16 | E:GLU53 | | 71.21 | 16.28||| | -0.02 |
| B:SER620 | | 73.21 | 36.85|||||| | 0.27 | E:ARG54 | | 115.05 | 11.48| | -0.13 |
| B:GLU621 | | 86.31 | 58.39|||||| | -0.27 | E:PRO56 | | 129.25 | 36.15||| | 0.58 |

35O22 interface with gp41 glycans (chain B)

| Light chain residues interacting with gp41 glycan NAG1618 | | | | | | | | | |
|---|---|---|---|---|---|---|---|---|---|
| 35O22 | HSD | ASA | BSA | ΔiG | gp41 | HSD | ASA | BSA | ΔiG |
| E:TYR49 | | 74.12 | 2.84| | -0.03 | B:NAG1618 | | 364.26 | 155.97||||| | -2.95 |
| E:ASN52 | | 101.39 | 14.60|| | -0.07 | | | | | |
| E:GLU53 | | 71.21 | 40.20|||||| | 0.28 | | | | | |
| E:ARG54 | | 115.05 | 60.92|||||| | -1.06 | | | | | |
| E:ALA55 | | 8.17 | 3.50||||| | -0.03 | | | | | |
| E:PRO56 | | 129.25 | 1.01| | 0.02 | | | | | |
| E:ILE58 | | 36.63 | 3.56| | -0.04 | | | | | |

FIG. 28B

35O22 heavy chain (chain D) and light chain (chain E) interface with gp120 (chain G)

| | Hydrogen bonds | | | | | | |
|---|---|---|---|---|---|---|---|
| | gp120 | Dist.[Å] | 35O22 | | gp120 | Dist.[Å] | 35O22 |
| 1 | G:GLU87[OE2] | 3.47 | D:TYR53[OH] | 4 | G:THR90[O] | 2.67 | D:SER72G[OG] |
| 2 | G:ASN88[O] | 3.52 | D:ARG28[NH1] | 5 | G:THR90[OG1] | 3.19 | D:ARG28[NH1] |
| 3 | G:ASN88[O] | 3.57 | D:ARG28[NH2] | 6 | G:GLU92[OE2] | 3.66 | D:SER72G[N] |

List of heavy chain-gp120 interface residues (the residues on each row are not matched interactive partners)

| gp120 | HSD* | ASA | BSA | ΔiG | 35O22 | HSD | ASA | BSA | ΔiG |
|---|---|---|---|---|---|---|---|---|---|
| G:GLU87 | H | 119.82 | 30.03\|\|\| | -0.04 | D:ARG28 | H | 61.56 | 41.29\|\|\|\|\|\|\| | -0.86 |
| G:ASN88 | H | 153.77 | 76.82\|\|\|\|\| | -0.45 | D:ASN30 | | 36.89 | 0.67\| | 0.01 |
| G:VAL89 | | 37.55 | 0.16\| | 0.00 | D:PHE31 | | 63.18 | 29.42\|\|\|\|\| | 0.47 |
| G:THR90 | H | 84.18 | 78.15\|\|\|\|\|\|\|\|\|\| | 0.06 | D:TYR53 | H | 174.22 | 57.23\|\|\|\| | 0.43 |
| G:GLU91 | | 30.92 | 6.18\|\| | -0.07 | D:GLU72B | | 31.31 | 3.07\| | -0.05 |
| G:GLU92 | H | 120.15 | 37.29\|\|\|\| | -0.20 | D:PRO72D | | 100.81 | 68.72\|\|\|\|\|\|\|\| | 0.94 |
| G:PRO238 | | 84.68 | 52.14\|\|\|\|\|\|\| | 0.79 | D:VAL72E | | 95.12 | 16.09\|\| | -0.14 |
| G:PRO240 | | 94.84 | 25.90\|\|\| | 0.41 | D:THR72F | | 81.85 | 25.64\|\|\|\| | 0.19 |
| | | | | | D:SER72G | H | 84.96 | 55.39\|\|\|\|\|\|\| | 0.12 |
| | | | | | D:ARG98 | | 153.80 | 14.44\| | -0.15 |

35O22 heavy chain (chain D) and light chain (chain E) interface with gp120 glycans (chain G)

| | Hydrogen bonds | | | | | | |
|---|---|---|---|---|---|---|---|
| | 35O22 | Dist.[Å] | gp120 | | 35O22 | Dist.[Å] | gp120 |
| 1 | D:ARG98[NH1] | 3.15 | G:NAG1088[O5] | 12 | E:HIS93[ND1] | 3.70 | G:BMA1090[O4] |
| 2 | D:ARG98[NH1] | 3.20 | G:NAG1088[O6] | 13 | E:ASN94[ND2] | 2.90 | G:MAN1092[O5] |
| 3 | D:HIS33[NE2] | 3.19 | G:NAG1089[O3] | 14 | E:ASN94[ND2] | 2.98 | G:MAN1092[O6] |
| 4 | D:THR100C[OG1] | 3.79 | G:NAG1089[O3] | | | | |
| 5 | D:SER52[OG] | 2.81 | G:NAG1089[O7] | | | | |
| 6 | D:ASP99[OD2] | 2.69 | G:NAG1089[O6] | | | | |
| 7 | D:THR100C[OG1] | 3.64 | G:BMA1090[O2] | | | | |
| 8 | D:GLY100[N] | 3.81 | G:MAN1091[O6] | | | | |
| 9 | D:ASP99[OD2] | 2.89 | G:MAN1091[O6] | | | | |
| 10 | D:ASN58[ND2] | 2.75 | G:MAN1093[O5] | | | | |
| 11 | D:LYS57[O] | 2.83 | G:MAN1093[O6] | | | | |

FIG. 28C

35O22 heavy chain (chain D) and light chain (chain E) interface with gp120 glycans (chain G)

Heavy chain residues interacting with gp120 glycans (interactive partners are shaded)

| 35O22 | HSD* | ASA | BSA | ΔiG | gp120 | HSD | ASA | BSA | ΔiG |
|---|---|---|---|---|---|---|---|---|---|
| D:ASN30 |   | 36.89 | 3.80 | -0.04 | G:NAG1088 | H | 361.66 | 152.80 | -2.90 |
| D:PHE31 |   | 63.18 | 14.73 | 0.21 |   |   |   |   |   |
| D:SER52 |   | 14.76 | 4.10 | -0.05 |   |   |   |   |   |
| D:TYR53 |   | 174.22 | 56.84 | 0.60 |   |   |   |   |   |
| D:ARG98 | H | 153.80 | 34.95 | 0.09 |   |   |   |   |   |
|   |   |   |   |   |   |   |   |   |   |
| D:ASN30 |   | 36.89 | 3.30 | -0.04 | G:NAG1089 | H | 351.65 | 208.97 | -3.87 |
| D:PHE31 |   | 63.18 | 6.93 | 0.03 |   |   |   |   |   |
| D:TYR32 |   | 53.73 | 2.88 | 0.04 |   |   |   |   |   |
| D:HIS33 | H | 31.99 | 27.65 | -0.34 |   |   |   |   |   |
| D:SER52 | H | 14.76 | 10.65 | -0.10 |   |   |   |   |   |
| D:PRO52A |   | 21.95 | 0.17 | 0.00 |   |   |   |   |   |
| D:TYR53 |   | 174.22 | 15.13 | 0.24 |   |   |   |   |   |
| D:SER54 |   | 79.25 | 0.49 | -0.01 |   |   |   |   |   |
| D:LEU97 |   | 90.59 | 0.34 | -0.00 |   |   |   |   |   |
| D:ARG98 |   | 153.80 | 29.55 | 0.07 |   |   |   |   |   |
| D:ASP99 | H | 118.53 | 28.74 | -0.23 |   |   |   |   |   |
| D:GLY100 |   | 52.83 | 1.75 | -0.02 |   |   |   |   |   |
| D:THR100C | H | 23.46 | 9.80 | 0.07 |   |   |   |   |   |
|   |   |   |   |   |   |   |   |   |   |
| D:HIS33 |   | 31.99 | 0.87 | -0.03 | G:BMA1090 | H | 290.20 | 66.73 | -1.33 |
| D:TRP50 |   | 35.25 | 6.06 | 0.10 |   |   |   |   |   |
| D:ASP56 |   | 82.09 | 5.52 | -0.03 |   |   |   |   |   |
| D:ARG98 |   | 153.80 | 2.90 | -0.03 |   |   |   |   |   |
| D:ASP99 |   | 118.53 | 8.40 | -0.05 |   |   |   |   |   |
| D:GLY100 |   | 52.83 | 16.78 | -0.19 |   |   |   |   |   |
| D:SER100A |   | 115.04 | 3.65 | 0.06 |   |   |   |   |   |
| D:THR100C | H | 23.46 | 13.65 | 0.07 |   |   |   |   |   |
| D:TRP100D |   | 96.11 | 0.78 | 0.01 |   |   |   |   |   |
|   |   |   |   |   |   |   |   |   |   |
| D:ASP99 | H | 118.53 | 22.92 | -0.26 | G:MAN1091 | H | 291.06 | 83.96 | -1.30 |
| D:GLY100 | H | 52.83 | 24.33 | -0.02 |   |   |   |   |   |
| D:SER100A |   | 115.04 | 21.29 | 0.32 |   |   |   |   |   |
|   |   |   |   |   |   |   |   |   |   |
| D:TRP50 |   | 35.25 | 13.76 | 0.22 | G:MAN1092 |   | 291.10 | 71.20 | -1.09 |
| D:ASP56 |   | 82.09 | 35.67 | -0.24 |   |   |   |   |   |
| D:LYS57 |   | 97.21 | 1.59 | -0.02 |   |   |   |   |   |
| D:ASN58 |   | 70.22 | 15.87 | -0.07 |   |   |   |   |   |
|   |   |   |   |   |   |   |   |   |   |
| D:TRP50 |   | 35.25 | 1.77 | 0.03 | G:MAN1093 |   | 291.76 | 65.49 | -0.59 |
| D:ASP56 |   | 82.09 | 6.71 | -0.08 |   |   |   |   |   |
| D:LYS57 | H | 97.21 | 14.49 | -0.17 |   |   |   |   |   |
| D:ASN58 | H | 70.22 | 37.81 | -0.30 |   |   |   |   |   |
| D:GLN64 |   | 112.58 | 0.14 | -0.00 |   |   |   |   |   |
|   |   |   |   |   |   |   |   |   |   |
| D:SER54 |   | 79.25 | 9.66 | 0.15 | G:MAN1094 |   | 291.56 | 44.25 | -1.07 |
| D:GLY55 |   | 40.15 | 0.00 | 0.00 |   |   |   |   |   |
| D:ASP56 |   | 82.09 | 30.40 | 0.18 |   |   |   |   |   |

FIG. 28D

35O22 heavy chain (chain D) and light chain (chain E) interface with gp120 glycans (chain G)

| 35O22 | HSD* | ASA | BSA | ΔiG | gp120 | HSD | ASA | BSA | ΔiG |
|---|---|---|---|---|---|---|---|---|---|
| D:PRO72D | | 100.81 | 2.52\| | -0.03 | G:NAG1234 | | 364.49 | 2.64\| | -0.03 |
| D:VAL72C | | 88.44 | 0.84\| | 0.01 | G:NAG1235 | | 364.33 | 52.98\|\| | -1.74 |
| D:PRO72D | | 100.81 | 12.83\|\| | -0.15 | | | | | |
| D:VAL72E | | 95.12 | 21.29\|\|\| | 0.10 | | | | | |

| Light chain residues interacting with gp120 glycans (interactive partners are shaded) | | | | | | | | | |
|---|---|---|---|---|---|---|---|---|---|
| 35O22 | HSD | ASA | BSA | ΔiG | gp120 | HSD | ASA | BSA | ΔiG |
| E:HIS93 | H | 185.68 | 48.93\|\|\| | 0.03 | G:BMA1090 | H | 290.20 | 51.57\|\| | -0.37 |
| E:ASN94 | | 129.52 | 10.53\| | -0.04 | | | | | |
| E:HIS93 | | 185.68 | 46.93\|\|\| | 0.38 | G:MAN1091 | | 291.06 | 49.91\|\| | -1.43 |
| E:HIS93 | | 185.68 | 8.20\| | -0.08 | G:MAN1092 | H | 291.10 | 52.50\|\| | -0.66 |
| E:ASN94 | H | 129.52 | 50.11\|\|\|\| | -0.48 | | | | | |
| E:ASN94 | | 129.52 | 43.33\|\|\|\| | -0.57 | G:MAN1093 | | 291.76 | 44.67\|\| | -1.35 |
| E:SER95 | | 60.35 | 0.34\| | 0.01 | | | | | |

FIG. 29A

PGT122 heavy chain (chain H) and light chain (chain L) interface with gp120 (chain G)

| Hydrogen bonds | | | | | | | |
|---|---|---|---|---|---|---|---|
| Type | gp120 | Dist.[Å] | PGT122 | Type | gp120 | Dist.[Å] | PGT122 |
| H* | G:ARG327[NH2] | 3.42 | H:TYR100B[O] | H | G:THR135[O] | 2.42 | L:ARG94[NE] |
| H | G:ARG327[NE] | 3.36 | H:GLU100I[OE1] | H | G:ILE322[O] | 3.16 | L:ARG94[NH1] |
| H | G:GLN328[N] | 3.29 | H:GLU100I[OE2] | H | G:GLY324[O] | 2.60 | L:ARG94[NH1] |
| H | G:ARG327[NE] | 3.36 | H:GLU100I[OE1] | H | G:ASP325[OD1] | 2.68 | L:SER30[N] |
| | | | | H | G:ASP325[OD1] | 2.95 | L:SER30[OG] |
| | | | | H | G:ASP325[OD1] | 2.80 | L:SER93[OG] |

List of heavy chain-gp120 interface residues (the residues on each row are not matched interactive partners)

| gp120 | HSD* | ASA | BSA | ΔiG | PGT122 | HSD | ASA | BSA | ΔiG |
|---|---|---|---|---|---|---|---|---|---|
| G:ASN137 | | 123.15 | 1.70\| | -0.02 | H:TYR100B | H | 139.30 | 66.62\|\|\|\| | 0.57 |
| G:THR139 | | 89.34 | 2.51\| | -0.01 | H:GLY100C | | 29.03 | 7.47\|\|\| | 0.08 |
| G:ASP141 | | 125.06 | 0.61\| | -0.01 | H:VAL100D | | 88.88 | 34.67\|\|\|\| | 0.55 |
| G:MET150 | | 82.97 | 8.11\| | 0.33 | H:ALA100F | | 91.59 | 3.32\| | 0.05 |
| G:ASP325 | | 109.50 | 35.59\|\|\|\| | 0.02 | H:PHE100G | | 159.25 | 111.47\|\|\|\|\|\| | 1.57 |
| G:ILE326 | | 52.34 | 10.65\|\|\| | -0.12 | H:LYS100H | | 166.63 | 8.38\| | 0.10 |
| G:ARG327 | HS | 131.02 | 76.40\|\|\|\|\| | -0.25 | H:GLU100I | HS | 64.86 | 54.78\|\|\|\|\|\|\| | -0.50 |
| G:GLN328 | H | 104.59 | 55.71\|\|\|\|\| | -0.12 | H:PHE100K | | 110.10 | 1.55\| | 0.02 |
| G:ALA329 | | 6.63 | 0.61\| | -0.01 | | | | | |
| G:HIS330 | | 41.10 | 18.00\|\|\|\|\| | -0.05 | | | | | |
| G:THR415 | | 80.97 | 31.04\|\|\|\| | 0.47 | | | | | |
| G:PRO417 | | 73.74 | 25.67\|\|\|\| | 0.40 | | | | | |

FIG. 29B

PGT122 heavy chain (chain H) and light chain (chain L) interface with gp120 (chain G)

List of light chain-gp120 interface residues (the residues on each row are not matched interactive partners)

| gp120 | HSD* | ASA | BSA | ΔiG | PGT122 | HSD | ASA | BSA | ΔiG |
|---|---|---|---|---|---|---|---|---|---|
| G:VAL134 |   | 15.62 | 3.68\|\|\| | 0.06 | L:LEU28 |   | 75.20 | 24.09\|\|\|\| | 0.18 |
| G:THR135 | H | 128.22 | 67.20\|\|\|\|\|\| | 0.77 | L:GLY29 |   | 8.25 | 8.01\|\|\|\|\|\|\|\|\| | 0.13 |
| G:ASN136 |   | 70.11 | 25.75\|\|\|\| | 0.23 | L:SER30 | H | 62.08 | 13.05\|\|\| | 0.02 |
| G:ASN137 |   | 123.15 | 68.20\|\|\|\|\|\| | 0.14 | L:PHE67C |   | 139.10 | 58.57\|\|\|\|\| | 0.84 |
| G:ILE138 |   | 121.22 | 1.51\| | 0.02 | L:ASP92 |   | 12.79 | 0.50\| | -0.01 |
| G:ASP321A |   | 84.62 | 2.96\| | 0.03 | L:SER93 | H | 81.90 | 27.48\|\|\|\| | -0.17 |
| G:ILE322 | H | 26.29 | 20.49\|\|\|\|\|\|\| | -0.19 | L:ARG94 | H | 157.44 | 141.21\|\|\|\|\|\|\|\|\| | -1.53 |
| G:ILE323 |   | 97.31 | 28.13\|\|\| | 0.38 | L:ARG95 |   | 110.87 | 19.10\|\| | -0.38 |
| G:GLY324 | H | 62.68 | 61.10\|\|\|\|\|\|\|\|\| | 0.21 | L:PRO95A |   | 108.78 | 26.57\|\|\| | 0.41 |
| G:ASP325 | H | 109.50 | 63.14\|\|\|\|\|\| | -0.45 | L:THR95B |   | 60.91 | 5.62\| | -0.06 |
| G:ILE326 |   | 52.34 | 13.09\|\|\| | 0.16 |   |   |   |   |   |

PGT122 heavy chain (chain H) and light chain (chain L) interface with gp120 glycans (chain G)

Hydrogen bonds

|   | PGT122 | Dist.[Å] | gp120 |   | PGT122 | Dist.[Å] | gp120 |
|---|---|---|---|---|---|---|---|
| 1 | H:THR100L[OG1] | 3.06 | G:NAG1138[O6] | 11 | L:THR95B[OG1] | 3.38 | G:NAG1137[N2] |
| 2 | H:ASN58[ND2] | 2.96 | G:NAG1138[O7] | 12 | L:ASN51[ND2] | 2.95 | G:MAN1338[O3] |
| 3 | H:ARG99[NE] | 3.73 | G:MAN1140[O4] | 13 | L:GLY67[N] | 3.37 | G:MAN1338[O3] |
| 4 | H:ARG99[NH2] | 3.28 | G:MAN1140[O3] | 14 | L:ASN51[ND2] | 2.79 | G:MAN1338[O4] |
| 5 | H:TYR33[OH] | 3.14 | G:MAN1140[O2] | 15 | L:ASN50[ND2] | 3.49 | G:MAN1338[O6] |
| 6 | H:GLY100C[O] | 3.89 | G:NAG1332[O6] | 16 | L:ASN52[ND2] | 3.83 | G:MAN1339[O2] |
| 7 | H:ARG100[NH2] | 3.89 | G:MAN1337[O2] |   |   |   |   |
| 8 | H:ARG100[NH1] | 3.35 | G:MAN1337[O5] |   |   |   |   |
| 9 | H:ARG100[NH2] | 3.22 | G:MAN1337[O6] |   |   |   |   |
| 10 | H:ARG100[NE] | 3.17 | G:MAN1338[O4] |   |   |   |   |

FIG. 29C

PGT122 heavy chain (chain H) and light chain (chain L) interface with gp120 glycans (chain G)

| Heavy chain residues interacting with gp120 glycans (interactive partners are shaded) | | | | | | | | | |
|---|---|---|---|---|---|---|---|---|---|
| PGT122 | HSD* | ASA | BSA | ΔiG | gp120 | HSD | ASA | BSA | ΔiG |
| H:ASN58 |  | 82.39 | 3.34 | -0.04 | G:NAG1137 |  | 363.36 | 64.91 | -1.28 |
| H:PHE100K |  | 110.10 | 40.05 | 0.64 |  |  |  |  |  |
| H:THR100L |  | 71.33 | 13.33 | -0.15 |  |  |  |  |  |
| H:TYR50 |  | 32.44 | 9.89 | -0.11 | G:NAG1138 | H | 361.16 | 67.39 | -1.08 |
| H:ASN58 | H | 82.39 | 28.86 | -0.24 |  |  |  |  |  |
| H:PHE100K |  | 110.10 | 0.15 | 0.00 |  |  |  |  |  |
| H:THR100L | H | 71.33 | 23.27 | -0.14 |  |  |  |  |  |
| H:TYR50 |  | 32.44 | 2.21 | -0.03 | G:BMA1139 |  | 292.42 | 52.46 | -0.60 |
| H:SER54 |  | 102.04 | 1.96 | -0.02 |  |  |  |  |  |
| H:GLY55 |  | 70.18 | 7.22 | -0.04 |  |  |  |  |  |
| H:ASP56 |  | 55.22 | 39.30 | 0.01 |  |  |  |  |  |
| H:THR57 |  | 50.88 | 1.31 | -0.01 |  |  |  |  |  |
| H:TYR33 | H | 39.27 | 19.22 | -0.22 | G:MAN1140 | H | 288.49 | 124.68 | -2.12 |
| H:ASP56 |  | 55.22 | 15.93 | 0.02 |  |  |  |  |  |
| H:HIS97 |  | 81.98 | 2.93 | 0.02 |  |  |  |  |  |
| H:ARG99 | H | 137.04 | 37.65 | -0.72 |  |  |  |  |  |
| H:TRP100J |  | 93.30 | 12.76 | 0.17 |  |  |  |  |  |
| H:THR100L |  | 71.33 | 24.31 | 0.24 |  |  |  |  |  |
| H:GLY100C |  | 29.03 | 1.81 | -0.02 | G:NAG1331 |  | 363.56 | 46.79 | -0.22 |
| H:VAL100D |  | 88.88 | 32.79 | 0.41 |  |  |  |  |  |
| H:ILE100A |  | 78.65 | 11.05 | 0.18 | G:NAG1332 | H | 355.60 | 104.64 | -1.96 |
| H:TYR100B |  | 139.30 | 8.08 | -0.06 |  |  |  |  |  |
| H:GLY100C | H | 29.03 | 14.32 | -0.14 |  |  |  |  |  |
| H:VAL100D |  | 88.88 | 21.43 | 0.24 |  |  |  |  |  |
| H:VAL100E |  | 71.06 | 21.76 | 0.35 |  |  |  |  |  |
| H:ARG100 |  | 126.64 | 6.29 | -0.07 | G:BMA1333 |  | 287.56 | 71.78 | -1.82 |
| H:ILE100A |  | 78.65 | 45.03 | 0.30 |  |  |  |  |  |
| H:TYR100B |  | 139.30 | 8.75 | 0.03 |  |  |  |  |  |
| H:GLY100C |  | 29.03 | 5.44 | -0.06 |  |  |  |  |  |
| H:VAL100E |  | 71.06 | 0.17 | 0.00 |  |  |  |  |  |
| H:ILE100A |  | 78.65 | 12.91 | 0.21 | G:MAN1334 |  | 289.35 | 14.25 | -0.37 |
| H:ARG100 | H | 126.64 | 26.73 | -0.73 | G:MAN1337 | H | 290.72 | 69.38 | -0.95 |
| H:ILE100A |  | 78.65 | 7.44 | -0.08 |  |  |  |  |  |
| H:TYR100B |  | 139.30 | 19.66 | 0.14 |  |  |  |  |  |
| H:ARG100 | H | 126.64 | 36.72 | -0.38 | G:MAN1338 | H | 290.85 | 50.03 | -0.94 |
| H:ILE100A |  | 78.65 | 2.22 | -0.03 |  |  |  |  |  |

FIG. 29D

PGT122 heavy chain (chain H) and light chain (chain L) interface with gp120 glycans (chain G)

| Light chain residues interacting with gp120 glycans (interactive partners are shaded) | | | | | | | | | |
|---|---|---|---|---|---|---|---|---|---|
| PGT122 | HSD | ASA | BSA | ΔiG | gp120 | HSD | ASA | BSA | ΔiG |
| L:TRP91 |  | 109.68 | 21.87 | 0.35 | G:NAG1137 | H | 363.36 | 114.45 | -3.21 |
| L:ASP92 |  | 12.79 | 9.29 | -0.07 |  |  |  |  |  |
| L:SER93 |  | 81.90 | 10.84 | 0.14 |  |  |  |  |  |
| L:ARG94 |  | 157.44 | 0.00 | 0.00 |  |  |  |  |  |
| L:ARG95 |  | 110.87 | 8.22 | -0.09 |  |  |  |  |  |
| L:PRO95A |  | 108.78 | 9.06 | 0.14 |  |  |  |  |  |
| L:THR95B | H | 60.91 | 28.01 | -0.27 |  |  |  |  |  |
| L:TRP96 |  | 223.52 | 0.31 | 0.00 | G:NAG1138 |  | 361.16 | 0.24 | -0.00 |
| L:ARG94 |  | 157.44 | 16.23 | -0.36 | G:NAG1156 |  | 362.08 | 16.35 | -0.54 |
| L:ARG95 |  | 110.87 | 6.55 | -0.07 | G:NAG1157 |  | 363.82 | 6.38 | -0.07 |
| L:GLU25 |  | 83.84 | 1.35 | -0.02 | G:MAN1159 |  | 289.29 | 1.28 | -0.04 |
| PGT122 | HSD | ASA | BSA | ΔiG | gp120 | HSD | ASA | BSA | ΔiG |
| L:SER30 |  | 62.08 | 10.76 | 0.17 | G:MAN1337 |  | 290.72 | 62.39 | -0.82 |
| L:GLY67 |  | 13.30 | 0.98 | -0.01 |  |  |  |  |  |
| L:SER67A |  | 77.94 | 44.21 | 0.62 |  |  |  |  |  |
| L:PHE67C |  | 139.10 | 7.35 | 0.12 |  |  |  |  |  |
| L:ARG31 |  | 14.38 | 0.98 | -0.01 | G:MAN1338 | H | 290.85 | 104.08 | -1.04 |
| L:ASN50 | H | 71.14 | 33.52 | -0.41 |  |  |  |  |  |
| L:ASN51 | H | 18.57 | 11.39 | -0.05 |  |  |  |  |  |
| L:ASN52 |  | 72.55 | 1.17 | 0.02 |  |  |  |  |  |
| L:ASP53 |  | 60.91 | 0.61 | -0.01 |  |  |  |  |  |
| L:PRO66 |  | 83.14 | 12.23 | 0.20 |  |  |  |  |  |
| L:GLY67 | H | 13.30 | 3.86 | 0.00 |  |  |  |  |  |
| L:SER67A |  | 77.94 | 14.20 | 0.20 |  |  |  |  |  |
| L:ASN51 |  | 18.57 | 2.74 | 0.03 | G:MAN1339 | H | 287.69 | 77.17 | -1.13 |
| L:ASN52 | H | 72.55 | 23.68 | 0.09 |  |  |  |  |  |
| L:ASP53 |  | 60.91 | 5.04 | -0.09 |  |  |  |  |  |
| L:PRO66 |  | 83.14 | 28.74 | 0.46 |  |  |  |  |  |
| L:GLY67 |  | 13.30 | 0.58 | -0.01 |  |  |  |  |  |
| L:SER67A |  | 77.94 | 7.10 | -0.06 |  |  |  |  |  |

FIG. 30A

| Serum ID | 6101.10 | Bal.01 | BG1168.01 | CAAN.A2 | DU156.12 | DU422.01 | JRCSF.JB | JRFL.JB | KER2018.11 | PVO.04 | Q168.a2 |
|---|---|---|---|---|---|---|---|---|---|---|---|
| 703010505 | 65 | 376 | 41 | 62 | 304 | 220 | 242 | 1370 | 123 | <40 | 220 |
| 703011754 | 124 | 1097 | 69 | 280 | 1535 | 895 | 813 | 335 | 572 | <40 | 184 |
| 703010894 | 158 | 314 | <40 | 57 | 150 | 53 | 1258 | 628 | <40 | 282 | 116 |
| 703010848 | 240 | 303 | <40 | 899 | 144 | 139 | 273 | 474 | <40 | 135 | <40 |
| 703011244 | 126 | 111 | <40 | 44 | 106 | 152 | 258 | 79 | 44 | <40 | <40 |
| 703010010 | <40 | 263 | <40 | <40 | <40 | <40 | 165 | <40 | <40 | 53 | 41 |
| 700010592 | <40 | 361 | <40 | 63 | 54 | <40 | 89 | <40 | <40 | 105 | <40 |
| 704010083 | <40 | <40 | <40 | 127 | 99 | 68 | 52 | 77 | <40 | <40 | <40 |
| 702010047 | <40 | 184 | <40 | <40 | <40 | 108 | 5837 | <40 | <40 | <40 | 90 |
| 707010457 | 113 | 152 | <40 | 44 | 390 | 467 | 87 | 700 | 146 | 1304 | 351 |
| 703011852 | 437 | 287 | <40 | 439 | 998 | 974 | 553 | 1245 | 76 | 352 | 87 |
| 707010219 | 167 | 175 | 187 | 179 | 219 | 142 | 55991 | 2203 | 3421 | 1835 | 3640 |
| 703011749 | 208 | 241 | <40 | 87 | 998 | 310 | 5221 | 3668 | <40 | 1183 | 56 |
| 704010581 | 273 | 1193 | 69 | 282 | 787 | 337 | 1415 | 652 | 199 | 1009 | 135 |
| 703010547 | 98 | 121 | <40 | 127 | 1324 | 508 | 101 | 459 | 57 | 226 | 68 |
| 703010401 | 189 | 472 | 188 | 477 | 3179 | 918 | 1653 | 876 | 780 | 777 | 1869 |
| 707010763 | 548 | 857 | <40 | 163 | 3447 | 1913 | 208 | 1209 | 3140 | 300 | 192 |
| 704010210 | 246 | 298 | 76 | <40 | 3107 | 400 | 150 | 60 | <40 | 211 | <40 |
| 707010175 | 83 | 81 | 48 | 71 | 400 | 170 | 322 | 244 | 66 | 325 | 118 |
| 703010269 | 138 | 639 | <40 | <40 | 444 | 97 | 2514 | 117 | <40 | 1041 | <40 |
| 702010440 | 142 | 89 | 57 | 117 | 354 | 154 | 609 | 306 | 42 | 892 | 73 |
| 705010741 | <40 | 101 | <40 | <40 | 417 | 140 | 1171 | <40 | <40 | 45 | 60 |
| 704010343 | 218 | 511 | <40 | 96 | 297 | 162 | 1397 | 842 | <40 | 875 | <40 |
| 705010765 | 287 | 260 | <40 | 517 | 769 | 458 | 1630 | 658 | <40 | 427 | <40 |
| 702010432 | 64 | 279 | <40 | 164 | 197 | 76 | 996 | 191 | 1413 | 61 | <40 |
| 704010461 | 86 | 214 | <40 | <40 | 549 | 58 | 59 | 74 | <40 | 208 | <40 |
| 707010562 | 94 | 458 | <40 | 109 | 340 | 97 | 9672 | 1132 | <40 | 81 | 787 |
| 706010383 | 292 | 374 | 84 | 1216 | 198 | 247 | 346 | 123 | 50 | 109 | 2154 |
| 704010540 | 135 | 193 | <40 | <40 | 176 | 50 | 131 | 181 | <40 | 83 | 281 |
| 713080258 | <40 | 534 | 51 | 82 | 51 | 83 | 171 | 310 | 59 | 81 | 157 |
| 707010277 | 80 | 301 | <40 | 62 | 667 | 203 | 41 | 425 | <40 | 76 | 238 |
| 702010293 | 66 | 504 | <40 | 244 | 322 | 218 | 346 | 617 | <40 | 48 | 46 |
| 700010111 | 168 | 785 | 46 | <40 | 227 | 194 | 451 | 116 | <40 | 175 | 763 |
| 707010232 | <40 | 270 | <40 | 50 | 233 | 144 | 263 | <40 | 638 | 52 | 1754 |
| 702010141 | 122 | 226 | <40 | 51 | 78 | <40 | 71 | <40 | <40 | 68 | 760 |
| 701010211 | 55 | 177 | 76 | 54 | 79 | <40 | 181 | 159 | <40 | 63 | 533 |
| 700010333 | 54 | 410 | <40 | 75 | <40 | <40 | <40 | 147 | <40 | 66 | 696 |
| 705010406 | <40 | 79 | <40 | <40 | 54 | 175 | 416 | 202 | 84 | 43 | <40 |
| 707010060 | <40 | 123 | <40 | <40 | 76 | 49 | 149 | 51 | <40 | <40 | 181 |

FIG. 30B

| Serum ID | Q23.17 | Q769.h5 | RW020.2 | THRO.18 | TRJO.58 | TRO.11 | YU2.DG | ZA012.29 | ZM106.9 | ZM55.28a |
|---|---|---|---|---|---|---|---|---|---|---|
| 703010505 | 180 | 62 | 320 | <40 | <40 | 61 | 250 | 50 | 56 | 65 |
| 703011754 | 1209 | 349 | 524 | 42 | <40 | <40 | 455 | 115 | 193 | 79 |
| 703010694 | 435 | 31 | 1073 | <40 | 125 | 144 | 264 | 252 | 90 | <40 |
| 703010848 | 1483 | <40 | 5883 | <40 | <40 | 434 | 122 | 136.5 | 440 | 239 |
| 703011244 | 124 | 84 | 296 | 47 | <40 | 116 | <40 | <40 | <40 | <40 |
| 703010010 | 91 | 44 | 71 | 58 | <40 | 67 | 104 | <40 | <40 | 43 |
| 700010592 | 270 | <40 | <40 | <40 | <40 | 68 | <40 | <40 | <40 | 46 |
| 704010083 | <40 | <40 | 102 | <40 | <40 | <40 | <40 | 67 | 110 | <40 |
| 702010047 | <40 | <40 | 51 | 224 | <40 | 196 | <40 | <40 | <40 | <40 |
| 707010457 | 83 | 613 | 1591 | 217 | 740 | 684 | 841 | 187 | 170 | 698 |
| 703011852 | 826 | 77 | 7041 | <40 | 91 | 2652 | 786 | 403 | 301 | 389 |
| 707010219 | 7177 | 19080 | 1172 | 7584 | 386 | 2792 | 976 | 219 | 487 | 5522 |
| 703011749 | 755 | 177 | 2312 | 60 | 232 | 602 | 174 | <40 | 750 | 153 |
| 704010581 | 639 | 109 | 2129 | 267 | 985 | 2695 | 892 | 178 | 306 | 163 |
| 703010547 | 996 | <40 | 4754 | <40 | 57 | 1912 | 583 | 54 | 481 | 130 |
| 703010401 | 992 | 1193 | 760 | 937 | 1876 | 1962 | 490 | 359 | 706 | 1628 |
| 707010763 | 54827 | <40 | 2155 | <40 | <40 | 854 | 207 | 299 | 551 | 146 |
| 704010210 | 78 | <40 | 329 | 78 | <40 | 168 | <40 | 63 | <40 | <40 |
| 707010175 | 861 | 76 | 1335 | 182 | 118 | 272 | 144 | <40 | 149 | 73 |
| 703010269 | 1160 | <40 | 606 | 208 | <40 | 414 | 120 | 128 | 72 | 61 |
| 702010440 | 88 | <40 | 613 | 110 | 275 | 562 | 93 | <40 | 87 | 59 |
| 705010741 | 94 | <40 | 66 | <40 | 134 | <40 | <40 | <40 | 50 | <40 |
| 704010343 | 107 | <40 | 1629 | 46 | 594 | 148 | 194 | <40 | 252 | 109 |
| 705010765 | 845 | <40 | 2514 | 57 | 112 | 1043 | 221 | 424 | 804 | 151 |
| 702010432 | 2108 | <40 | 322 | <40 | 97 | 153 | 58 | 248 | 955 | 55 |
| 704010461 | 67 | <40 | 125 | <40 | 337 | 456 | 130 | <40 | 232 | <40 |
| 707010562 | 2467 | 433 | 3603 | 41 | 145 | 647 | 360 | 122 | 383 | 174 |
| 706010383 | 94 | <40 | 193 | 153 | 255 | 522 | 94 | 50 | 150 | 92 |
| 704010540 | 46 | 113 | 319 | 165 | 345 | 205 | 129 | 83 | 219 | 99 |
| 713080258 | <40 | 58 | 51 | <40 | 200 | 154 | 53 | 51 | 120 | 58 |
| 707010277 | 177 | 266 | 404 | 231 | <40 | 102 | 136 | 68 | 52 | 78 |
| 702010293 | 547 | <40 | 1030 | 108 | <40 | 211 | 89 | 63 | 166 | 42 |
| 700010111 | 277 | <40 | 1053 | 107 | 468 | 457 | 399 | 41 | 143 | 58 |
| 707010232 | 1023 | 75 | 1640 | 51 | 43 | 60 | <40 | <40 | 102 | 48 |
| 702010141 | 45 | <40 | 258 | 52 | 47 | 135 | 60 | 59 | 170 | 116 |
| 701010211 | 135 | <40 | <40 | 47 | 197 | 78 | 59 | 46 | <40 | <40 |
| 700010333 | <40 | <40 | <40 | 70 | 53 | 79 | 57 | <40 | 71 | 99 |
| 705010406 | 146 | <40 | 80 | <40 | <40 | 93 | <40 | 43 | 82 | <40 |
| 707010060 | 125 | <40 | 161 | <40 | 67 | <40 | <40 | <40 | 48 | <40 |

FIG. 31

| Evasion mechanism | Structural implementation |
|---|---|
| Conformational masking | Trimer association domains cover conserved sites of receptor recognition; these sites are only exposed at the target cell membrane. |
| Sequence variation | High surface sequence variation, such as observed for the α2 and V4 on the outer domain, allow escape from strain-specific antibodies. |
| Glycan shielding | N-linked glycosylation covers the spike apex, leaving few glycan-free surface available for antibody recognition. |
| Single spike entry | MPER regions associate with membrane, and assist in fusing viral and cell membranes. |

FIG. 33C

Binding antigenicity of BG505 SOSIP.664 variants

FIG. 33D

Unliganded trimer structural compatibility versus BG505 SOSIP.664 201C-433C binding antigenicity Physical properties of BG505 SOSIP.664 201C-433C

FIG. 35B

Antigenic characteristics of SOS virus-like particles (VLPs)

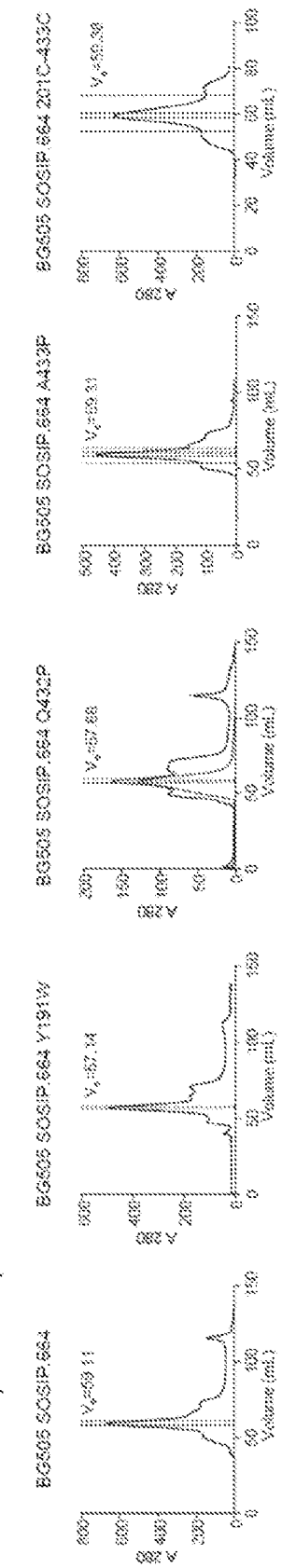

Temporal Stability of SOSIP, 201C-433C and A433P

Antigenicity of purifies BG505 SOSIP.664 and 201C-433C
in absence and presence of CD4

Antigenicity of purified BG505 SOSIP.664 and 201C-433C by ELISA

Pairwise correlation between MSD-ECLIA and ELISA

Affinity and kinetics of interaction of BG505 SOSIP.664 and 201C-433C by surface plasmon resonance Affinity and kinetics of interaction of BG505 SOSIP.664 and 201C-433C by biolayer interferometry

FIG. 38C

Binding affinity (KD in nM) of BG505 SOSIP.664 and 201C-433C with a panel of antibodies (Table content illegible due to image resolution)

FIG. 38D

Pairwise comparison of antigenicity data by 4 methods (MSD, ELISA, BLI and SPR)

| | BG505 SOSIP 664 | | 201C-433C | | |
|---|---|---|---|---|---|
| | Spearman r | p | Spearman r | p | n |
| MSD vs ELISA | 0.7653 | 0.0006 | 0.6412 | <0.00012 | 16 |
| MSD vs SPR | -0.8664 | 0.00015 | -0.8436 | <0.00012 | 14 |
| ELISA vs SPR | -0.8969 | <0.00015 | -0.9224 | <0.00012 | 14 |
| SPR vs BLI | 0.9730 | 0.0046 | 0.9730 | 0.0048 | 8 |
| MSD vs BLI | -0.9132 | <0.00015 | -0.8679 | <0.00012 | 8 |
| BLI vs ELISA | -0.9132 | <0.00015 | -0.9132 | <0.00012 | 8 |

Conformational triggering of co-receptor site: 17b detection (+/− CD4)

Conformational triggering of HR2-site: C34 detection (−/+ CD4)

Enhanced CD4-induction of P313W mutant: 17b detection (+sCD4)

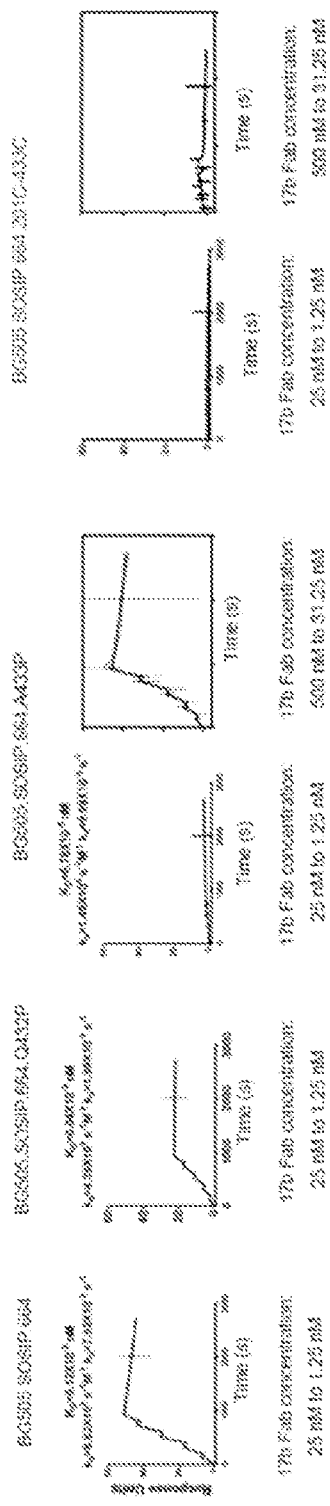
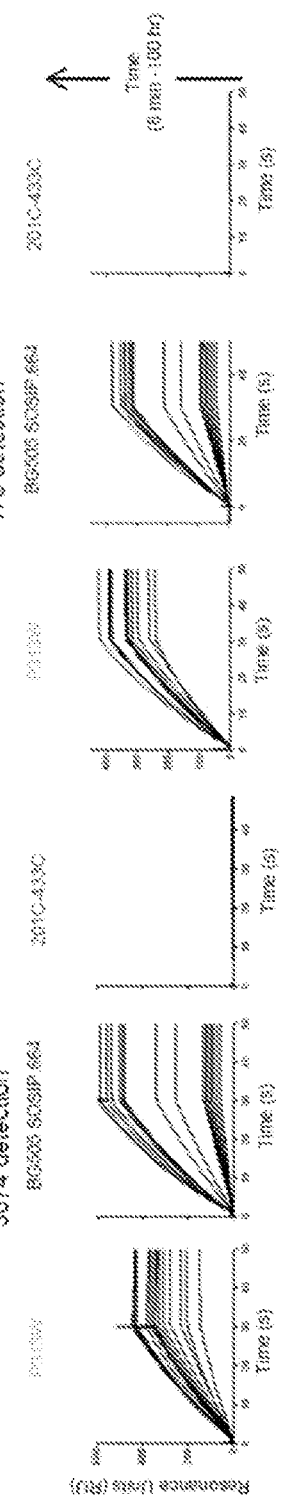
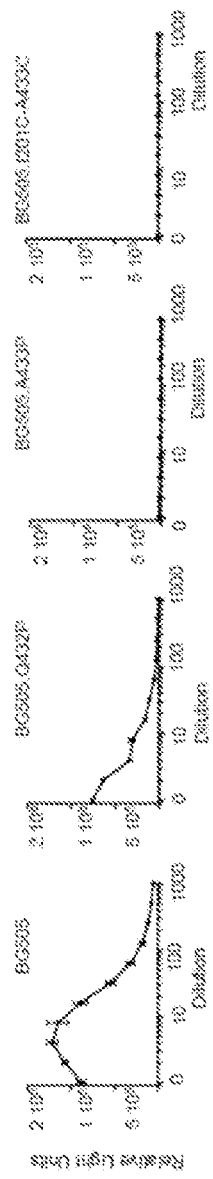
FIG. 40C
FIG. 40D
FIG. 40E

FIG. 42A

| Construct | VRC26 | PGT145 | F105 | 17b + sCD4 | 17b | PGT122 | VRC01 | 447-52D | 447-52D + sCD4 | PGT151 | PGT151+ sCD4+17b |
|---|---|---|---|---|---|---|---|---|---|---|---|
| BG505gp140.6R.SOSIP.664.T332N_V127F | - | - | (+) | (+++) | (++) | (++) | (+++) | | | | |
| BG505gp140.6R.SOSIP.664.T332N_V127W | - | - | (+) | (+++) | (++) | (++) | (+++) | | | | |
| BG505gp140.6R.SOSIP.664.T332N_E153F | (++) | (+++) | (+) | (+++) | (+) | (+++) | (+++) | | | | |
| BG505gp140.6R.SOSIP.664.T332N_E153W | (+++) | (+++) | - | (+++) | (+) | (+++) | (+++) | | | | |
| BG505gp140.6R.SOSIP.664.T332N_L154F | (+++) | (+++) | - | (+++) | (+) | (+++) | (+++) | | | | |
| BG505gp140.6R.SOSIP.664.T332N_L154W | (+++) | (+++) | - | (+++) | (+) | (+++) | (+++) | | | | |
| BG505gp140.6R.SOSIP.664.T332N_E164F | (+++) | (+++) | - | (+++) | (+) | (+++) | (+++) | | | | |
| BG505gp140.6R.SOSIP.664.T332N_E164W | (+++) | (+++) | - | (+++) | (+) | (+++) | (+++) | | | | |
| BG505gp140.6R.SOSIP.664.T332N_L165F | - | (++) | - | (+++) | (+) | (++) | (+++) | | | | |
| BG505gp140.6R.SOSIP.664.T332N_L165W | - | (+) | - | (+++) | (++) | (+++) | (+++) | | | | |
| BG505gp140.6R.SOSIP.664.T332N_R166F | - | (+) | - | (+++) | - | (+++) | (+++) | | | | |
| BG505gp140.6R.SOSIP.664.T332N_R166W | - | (++) | - | (+++) | - | (+++) | (+++) | | | | |
| BG505gp140.6R.SOSIP.664.T332N_D167F | - | - | - | (+++) | (++) | (++) | (+++) | | | | |
| BG505gp140.6R.SOSIP.664.T332N_D167W | - | - | - | (+++) | (++) | (+++) | (+++) | | | | |
| BG505gp140.6R.SOSIP.664.T332N_L175F | (++) | (+++) | - | (+++) | (++) | (+++) | (+++) | | | | |
| BG505gp140.6R.SOSIP.664.T332N_L175W | (+) | (+++) | - | (+++) | (++) | (+++) | (+++) | | | | |
| BG505gp140.6R.SOSIP.664.T332N_T198F | (++) | (+++) | - | (+++) | (+) | (+++) | (+++) | | | | |
| BG505gp140.6R.SOSIP.664.T332N_T198W | (++) | (+++) | - | (+++) | (+) | (+++) | (+++) | | | | |
| BG505gp140.6R.SOSIP.664.T332N_T202F | (+++) | (+++) | - | (+++) | - | (+++) | (+++) | | | | |
| BG505gp140.6R.SOSIP.664.T332N_T202W | (+++) | (+++) | - | (+++) | - | (+++) | (+++) | | | | |
| BG505gp140.6R.SOSIP.664.T332N_A204F | (+++) | (+++) | - | (+++) | - | (+++) | (+++) | | | | |
| BG505gp140.6R.SOSIP.664.T332N_A204W | (+++) | (+++) | - | (+++) | - | (+++) | (+++) | | | | |
| BG505gp140.6R.SOSIP.664.T332N_N302F | (+++) | (+++) | - | (+++) | - | (+++) | (+++) | | | | |
| BG505gp140.6R.SOSIP.664.T332N_N302W | (+++) | (+++) | - | (+++) | - | (+++) | (+++) | | | | |
| BG505gp140.6R.SOSIP.664.T332N_K421F | - | - | - | (++) | - | (+) | (+++) | | | | |
| BG505gp140.6R.SOSIP.664.T332N_K421W | - | - | - | (+) | - | (+) | (++) | | | | |
| BG505gp140.6R.SOSIP.664.T332N_Q422F | - | - | - | (++) | - | (+) | (+++) | | | | |
| BG505gp140.6R.SOSIP.664.T332N_Q422W | - | - | - | (++) | - | (+) | (+++) | | | | |
| BG505gp140.6R.SOSIP.664.T332N_I423F | (+++) | (+++) | - | (+++) | - | (+++) | (+++) | | | | |
| BG505gp140.6R.SOSIP.664.T332N_I423W | - | - | (++) | (+++) | - | (++) | (+++) | | | | |
| BG505gp140.6R.SOSIP.664.T332N_Q432F | (++) | (+++) | - | (+++) | - | (+++) | (+++) | | | | |
| BG505gp140.6R.SOSIP.664.T332N_Q432W | (++) | (+++) | - | (+++) | - | (+++) | (+++) | | | | |
| BG505gp140.6R.SOSIP.664.T332N_A436M | (+++) | (+++) | - | (+++) | - | (+++) | (+++) | | | | |
| BG505gp140.6R.SOSIP.664.T332N_A436F | (+++) | (+++) | - | (+++) | - | (+++) | (+++) | | | | |
| BG505gp140.6R.SOSIP.664.T332N_A436W | (+++) | (+++) | - | (+++) | - | (+++) | (+++) | | | | |
| BG505gp140.6R.SOSIP.664.T332N_T162F | - | - | - | (+++) | - | (+++) | (+++) | | | | |
| BG505gp140.6R.SOSIP.664.T332N_T162W | - | - | - | (+++) | - | (+++) | (+++) | | | | |
| BG505gp140.6R.SOSIP.664.T332N_T163F | - | (++) | - | (+++) | (+) | (++) | (+++) | | | | |
| BG505gp140.6R.SOSIP.664.T332N_T163W | - | (++) | - | (+++) | (+) | (++) | (+++) | | | | |
| BG505gp140.6R.SOSIP.664.T332N_V172F | (+++) | (+++) | - | (+++) | (+) | (+++) | (+++) | | | | |
| BG505gp140.6R.SOSIP.664.T332N_V172W | (+++) | (+++) | (+) | (+++) | (++) | (+++) | (+++) | | | | |
| BG505gp140.6R.SOSIP.664.T332N_F176W | (+++) | (+++) | - | (+++) | - | (+++) | (+++) | | | | |
| BG505gp140.6R.SOSIP.664.T332N_R304F | (++) | (+++) | - | (+++) | - | (+++) | (+++) | | | | |
| BG505gp140.6R.SOSIP.664.T332N_R304W | (++) | (+++) | - | (+++) | - | (+++) | (+++) | | | | |
| BG505gp140.6R.SOSIP.664.T332N_Q315F | (+++) | (+++) | - | (+++) | - | (+++) | (+++) | | | | |
| BG505gp140.6R.SOSIP.664.T332N_Q315W | (+++) | (+++) | - | (+++) | - | (+++) | (+++) | | | | |
| BG505gp140.6R.SOSIP.664.T332N_I430F | (+++) | (+++) | - | (+++) | - | (+++) | (+++) | | | | |
| BG505gp140.6R.SOSIP.664.T332N_I430W | (+++) | (+++) | (+) | (+++) | - | (+++) | (+++) | | | | |
| BG505gp140.6R.SOSIP.664.T332N_W112A | (+) | (+++) | - | (+++) | - | (++) | (+++) | | | | |
| BG505gp140.6R.SOSIP.664.T332N_W112S | (+) | (+++) | - | (+++) | - | (++) | (+++) | | | | |
| BG505gp140.6R.SOSIP.664.T332N_W112R | - | (+) | - | (+++) | - | (+) | (+++) | | | | |
| BG505gp140.6R.SOSIP.664.T332N_F210A | (++) | (+++) | - | (+++) | - | (+++) | (+++) | | | | |

FIG. 42B

| Construct | VRC26 | PGT145 | F105 | 17b + sCD4 | 17b | PGT122 | VRC01 | 447-52D | 447-52D +sCD4 | PGT151 | PGT151+ sCD4+17b |
|---|---|---|---|---|---|---|---|---|---|---|---|
| BG505gp140.6R.SOSIP.664.T332N_F210S | (++) | (+++) | - | (+++) | - | (+++) | (+++) | | | | |
| BG505gp140.6R.SOSIP.664.T332N_F210R | (+) | (+++) | - | (+++) | - | (+++) | (+++) | | | | |
| BG505gp140.6R.SOSIP.664.T332N_I307W | (+++) | (+++) | - | (+++) | - | (+++) | (+++) | | | | |
| BG505gp140.6R.SOSIP.664.T332N_I307F | (+++) | (+++) | - | (+++) | (+) | (+++) | (+++) | | | | |
| BG505gp140.6R.SOSIP.664.T332N_K121W | (+) | (+) | (+) | (+++) | - | (++) | (+++) | | | | |
| BG505gp140.6R.SOSIP.664.T332N_K121F | (+) | (++) | - | (+++) | - | (+++) | (+++) | | | | |
| BG505gp140.6R.SOSIP.664.T332N_Y318C.P437C | (+) | (++) | - | (+++) | - | (++) | (+++) | | | | |
| BG505gp140.6R.SOSIP.664.T332N_I202C.K121C | - | - | (++) | (+++) | - | (++) | (+++) | | | | |
| BG505gp140.6R.SOSIP.664.T332N_Q203C.V120C | - | - | (++) | (+++) | - | (++) | (+++) | | | | |
| BG505gp140.6R.SOSIP.664.T332N_I309C.T163C | - | - | - | (++) | - | (++) | (+++) | | | | |
| BG505gp140.6R.SOSIP.664.T332N_313C.198C | - | - | - | (+++) | - | (++) | (+++) | | | | |
| BG505gp140.6R.SOSIP.664.T332N_315C.189C | - | - | - | (+++) | - | (++) | (+++) | | | | |
| BG505gp140.6R.SOSIP.664.T332N_312C.163C | - | - | - | (++) | - | (+) | (+++) | | | | |
| BG505gp140.6R.SOSIP.664.T332N_312C.164C | - | - | - | (+++) | - | (+) | (+++) | | | | |
| BG505gp140.6R.SOSIP.664.T332N.D7324_Y177C_N300C | - | - | - | (++) | - | (+) | (+++) | | | | |
| BG505gp140.6R.SOSIP.664.T332N.97324_Y177C_I420C | - | - | - | (+) | - | (+) | (+++) | | | | |
| BG505gp140.6R.SOSIP.664.T332N.D7324_Y177C_K421C | - | - | - | - | - | (+) | (+) | | | | |
| BG505gp140.6R.SOSIP.664.T332N.D7324_F176C_I423C | - | - | - | (++) | - | (++) | (+++) | | | | |
| BG505gp140.6R.SOSIP.664.T332N.D7324_L175C_N302C | (+) | (++) | - | (+++) | - | (++) | (+++) | | | | |
| BG505gp140.6R.SOSIP.664.T332N.97324_L175C_T320C | - | - | - | (++) | - | (+) | (+++) | | | | |
| BG505gp140.6R.SOSIP.664.T332N.D7324_M161C_F317C | - | - | - | (+++) | - | (+) | (+++) | | | | |
| BG505gp140.6R.SOSIP.664.T332N.D7324_E153C_K421C | - | - | - | - | - | (+) | (++) | | | | |
| BG505gp140.6R.SOSIP.664.T332N_P313GCG.T198C | - | - | - | (+++) | - | (+) | (+++) | | | | |
| BG505gp140.6R.SOSIP.664.T332N_P313GGCGG.T198C | - | - | - | (+++) | - | (+) | (+++) | | | | |
| BG505gp140.6R.SOSIP.664.T332N_L175C.G321C | - | - | - | (+) | - | (+) | (++) | | | | |
| BG505gp140.6R.SOSIP.664.T332N_(312)C.T163C | - | - | - | (++) | - | (+) | (+++) | | | | |
| BG505gp140.6R.SOSIP.664.T332N_(313)C.T163C | - | - | - | (++) | - | (+) | (+++) | | | | |
| BG505gp140.6R.SOSIP.664.T332N_(312)C.T164C | - | - | - | (++) | - | (+) | (+++) | | | | |
| BG505gp140.6R.SOSIP.664.T332N_(313)C.T164C | - | - | - | (++) | - | (+) | (+++) | | | | |
| BG505gp140.6R.SOSIP.664.T332N_I326C.T139C | (+++) | (++) | - | (++) | - | (++) | (+++) | | | | |
| BG505gp140.6R.SOSIP.664.T332N_I326C.D140C | - | (++) | - | (+) | - | (++) | (++) | | | | |
| BG505gp140.6R.SOSIP.664.T332N_L129C_L193C | - | - | (++) | (+) | (+) | (++) | (++) | | | | |
| BG505gp140.6R.SOSIP.664.T332N_Q130C_R192C | - | - | (++) | (++) | (+) | (++) | (++) | | | | |
| BG505gp140.6R.SOSIP.664.T332N_T132C_E190C | - | - | (+) | (++) | - | (+) | (+) | | | | |
| BG505gp140.6R.SOSIP.664.T332N_N133C_K189C | - | (+) | (++) | (++) | - | (++) | (++) | | | | |
| BG505gp140.6R.SOSIP.664.T332N_V134C_N188C | - | - | (++) | (+) | (+) | (++) | (++) | | | | |
| BG505gp140.6R.SOSIP.664.T332N_N156C_L175C | - | - | (++) | - | - | (+) | (+) | | | | |
| BG505gp140.6R.SOSIP.664.T332N_K155C_F176C | - | - | (++) | - | - | (+) | (+) | | | | |
| BG505gp140.6R.SOSIP.664.T332N_L154C_Y177C | - | - | (++) | - | - | (+) | (+) | | | | |
| BG505gp140.6R.SOSIP.664.T332N_E153C_R178C | - | (+) | (++) | (+++) | - | (+++) | (++) | | | | |
| BG505gp140.6R.SOSIP.664.T332N_G152C_L179C | - | - | (++) | (+) | - | (+) | (++) | | | | |
| BG505gp140.6R.SOSIP.664.T332N_V134C_L154C | - | - | (++) | (++) | (+) | (++) | (++) | | | | |
| BG505gp140.6R.SOSIP.664.T332N_V134C_N156C | - | - | (++) | (+) | - | (+) | (+) | | | | |
| BG505gp140.6R.SOSIP.664.T332N_N136_R151C | - | (+++) | (++) | (+++) | - | (+++) | (++) | | | | |
| BG505gp140.6R.SOSIP.664.T332N_L179F | (++) | (++) | - | (++) | - | (+++) | (++) | | | | |
| BG505gp140.6R.SOSIP.664.T332N_L179W | (++) | (+++) | - | (+++) | (+) | (+++) | (++) | | | | |
| BG505gp140.6R.SOSIP.664.T332N_D180F | - | - | (++) | - | - | (+) | (+) | | | | |
| BG505gp140.6R.SOSIP.664.T332N_D180W | - | - | (++) | - | - | (+) | (+) | | | | |
| BG505gp140.6R.SOSIP.664.T332N_V181F | - | - | (++) | (++) | - | (++) | (++) | | | | |
| BG505gp140.6R.SOSIP.664.T332N_V181W | - | - | (++) | (+) | - | (+) | (++) | | | | |
| BG505gp140.6R.SOSIP.664.T332N_V182F | (+) | (+++) | - | (+++) | (+) | (+++) | (+++) | | | | |
| BG505gp140.6R.SOSIP.664.T332N_V182W | - | (+++) | - | (+++) | (+) | (+++) | (++) | | | | |
| BG505gp140.6R.SOSIP.664.T332N_Y191F | (++) | (+++) | - | (++) | - | (+++) | (++) | | | | |
| BG505gp140.6R.SOSIP.664.T332N_Y191W | (++) | (+++) | - | (++) | - | (+++) | (++) | | | | |
| BG505gp140.6R.SOSIP.664.T332N_L193F | (+++) | (+++) | - | (+++) | - | (+++) | (++) | | | | |
| BG505gp140.6R.SOSIP.664.T332N_L193W | (++) | (+++) | - | (+++) | - | (+++) | (++) | | | | |
| BG505gp140.6R.SOSIP.664.T332N_I194F | - | (++) | - | (+) | - | (++) | (++) | | | | |

FIG. 42C

| Construct | VRC26 | PGT145 | F105 | 17b + sCD4 | 17b | PGT122 | VRC01 | 447-52D | 447-52D + sCD4 | PGT151 | PGT151+ sCD4+17b |
|---|---|---|---|---|---|---|---|---|---|---|---|
| BG505gp140.6R.SOSIP.664.T332N_I194W | (++) | (+++) | - | (+++) | - | (+++) | (+++) | | | | |
| BG505gp140.6R.SOSIP.664.T332N_V179F | - | - | (++) | (++) | (+) | (+) | (+) | | | | |
| BG505gp140.6R.SOSIP.664.T332N_L165Y | - | (+) | - | (+++) | (+) | (++) | (+++) | | | | |
| BG505gp140.6R.SOSIP.664.T332N_R166Y | - | - | - | (+) | - | (+++) | (++) | | | | |
| BG505gp140.6R.SOSIP.664.T332N_L165F_R166W_D167Y | - | - | (++) | (++) | - | (++) | (++) | | | | |
| BG505gp140.6R.SOSIP.664.T332N_L165F_R166W_D167F | - | - | (++) | (+++) | - | (++) | (++) | | | | |
| BG505gp140.6R.SOSIP.664.T332N_R166K_D167E | - | - | - | - | - | (+) | - | | | | |
| BG505gp140.6R.SOSIP.664.T332N_R166K_D167N | - | (+) | - | (+++) | (+) | (+++) | (+++) | | | | |
| BG505gp140.6R.SOSIP.664.T332N_L165F_R166K | - | - | - | (+++) | (+) | (+++) | (+++) | | | | |
| BG505gp140.6R.SOSIP.664.T332N_L165W_R166K | - | - | (++) | (+++) | (+) | (++) | (++) | | | | |
| BG505gp140.6R.SOSIP.664.T332N_R166C_D167C | - | - | - | - | - | (+) | (+) | | | | |
| BG505gp140.6R.SOSIP.664.T332N_L125W | - | - | (++) | (++) | (++) | (++) | (+) | | | | |
| BG505gp140.6R.SOSIP.664.T332N_L122C/I201C | - | - | (++) | - | - | (++) | (+) | | | | |
| BG505gp140.6R.SOSIP.664.T332N_L194W | (++) | (+++) | - | (+++) | - | (+++) | (+++) | | | | |
| *BG505gp140.6R.SOSIP.664.T332N_A433P | (++) | (+++) | - | - | - | (+++) | (+++) | | | | |
| *BG505gp140.6R.SOSIP.664.T332N_Q432P | (++) | (+++) | - | (+) | - | (+++) | (+++) | | | | |
| BG505gp140.6R.SOSIP.664.T332N_V2V3Charge1 | - | - | (++) | - | - | (+) | (++) | | | | |
| BG505gp140.6R.SOSIP.664.T332N_V2V5Charge2 | - | - | - | - | - | (+) | - | | | | |
| BG505gp140.6R.SOSIP.664.T332N_V2V3Charge3 | - | - | (++) | (+) | (+) | (++) | (++) | | | | |
| BG505gp140.6R.SOSIP.664.T332N_V2V5_Hyd1 | - | - | (++) | - | - | (++) | (++) | | | | |
| BG505gp140.6R.SOSIP.664.T332N_V2V3_Hyd2 | (++) | (+++) | - | (++) | - | (+++) | (++) | | | | |
| BG505gp140.6R.SOSIP.664.T332N_L125W.L194W | (++) | (+++) | - | (++) | - | (+++) | (+++) | | | | |
| BG505gp140.6R.SOSIP.664.T332N_L125W.L194W.A433P | - | - | - | - | - | (+) | (+) | | | | |
| BG505gp140.6R.SOSIP.664.T332N_Y173W | (+++) | (+++) | (+++) | (++) | (+++) | (+++) | (+++) | | | | |
| BG505gp140.6R.SOSIP.664.T332N_Y173F | (+) | (++) | - | (+++) | - | (++) | (++) | | | | |
| BG505gp140.6R.SOSIP.664.T332N_Y173C_A319C | - | - | - | - | - | (+) | - | | | | |
| BG505gp140.6R.SOSIP.664.T332N_Y177W | - | - | - | (+) | - | (++) | (++) | | | | |
| BG505gp140.6R.SOSIP.664.T332N_Y177F | - | - | - | - | - | (+) | (+) | | | | |
| BG505gp140.6R.SOSIP.664.T332N_A200C/P313C | - | (+) | (+) | - | - | (+++) | (+++) | | | | |
| BG505gp140.6R.SOSIP.664.T332N_T128C/D167C | - | - | (++) | (++) | (+) | (+++) | (+++) | | | | |
| BG505gp140.6R.SOSIP.664.T332N_W571C/C54A | (++) | (+++) | (++) | (+++) | - | (+++) | (+++) | | | | |
| BG505gp140.6R.SOSIP.664.T332N_W571C/T71C | (+) | (++) | - | (++) | - | (+++) | (+++) | | | | |
| BG505gp140.6R.SOSIP.664.T332N_V570C/Q114C | - | (+) | - | - | - | (+++) | (+++) | | | | |
| BG505gp140.6R.SOSIP.664.T332N_I523C/T244C | - | (++) | - | (+++) | - | (+++) | (+++) | | | | |
| BG505gp140.6R.SOSIP.664.T332N_W571C/Q114C | - | (+) | - | - | - | (+++) | (+++) | | | | |
| BG505gp140.6R.SOSIP.664.T332N_L179C/K421C | - | (+) | - | - | - | (++) | (+++) | | | | |
| BG505gp140.6R.SOSIP.664.T332N_L175C/T320C | - | - | - | - | - | (++) | (+++) | | | | |
| *BG505gp140.6R.SOSIP.664.T332N_I201C/A433C | (+++) | (+++) | - | - | - | (+++) | (+++) | (+) | (+) | (+++) | (+++) |
| BG505gp140.6R.SOSIP.664.T332N_M536W | (+) | (+++) | (+) | (+++) | (+) | (+++) | (+++) | | | | |
| BG505gp140.6R.SOSIP.664.T332N_K574C/T51C | - | (+) | - | (++) | - | (+++) | (+++) | | | | |
| BG505gp140.6R.SOSIP.664.T332N_P230C/A578C | - | - | - | (++) | - | (+++) | (+++) | | | | |
| BG505gp140.6R.SOSIP.664.T332N_L34C/W610C | - | - | (+++) | - | - | (++) | (++) | (++) | (+++) | (+) | - |
| BG505gp140.6R.SOSIP.664.T332N_G41C/Q540C | - | - | - | (++) | - | (+) | (+) | (+) | (++) | (++) | - |
| BG505gp140.6R.SOSIP.664.T332N_P43C/A526C | - | - | - | - | - | (+) | (++) | (+++) | (+++) | (++) | - |
| BG505gp140.6R.SOSIP.664.T332N_V89C/G527C | (+) | (+) | - | (+) | - | (++) | (++) | (+) | (++) | (+++) | (+) |
| BG505gp140.6R.SOSIP.664.T332N_E164C/G312C | - | - | - | - | - | (+) | (+) | - | - | - | - |
| *BG505gp140.6R.SOSIP.664.T332N_S174C/A319C | (+) | (+++) | (++) | - | - | (+++) | (+++) | - | (+) | (++) | (++) |
| BG505gp140.6R.SOSIP.664.T332N_G531C/W623C | (+) | (++) | (++) | (++) | - | (+++) | (+++) | (+) | (+++) | (+++) | (++) |
| BG505gp140.6R.SOSIP.664.T332N_S615C/E634C | - | - | (+++) | - | - | (+) | - | (++) | (+++) | - | - |
| BG505gp140.6R.SOSIP.664.T332N_S01C/A662C | (++) | (+++) | - | (+++) | (+) | (+++) | (+++) | (++) | (+++) | (+++) | (++) |
| BG505gp140.6R.SOSIP.664.T332N_S38C/Q652C | (++) | (+++) | - | (++) | - | (+++) | (+++) | (+++) | (+++) | (++) | - |
| BG505gp140.6R.IP.664.T332N_F53C/K574C | - | (+) | - | (++) | - | (++) | (+++) | (+++) | (+++) | (+) | - |
| BG505gp140.6R.IP.664.T332N_V89C/G527C | - | - | - | - | - | (+) | (+) | (+) | (+) | - | - |
| BG505gp140.6R.IP.664.T332N_P220C/A578C | - | - | - | - | - | (++) | (++) | (+++) | (+++) | - | - |
| *BG505gp140.6R.IP.664.T332N_A221C/A582C | (+) | (++) | - | (+) | - | (+++) | (+++) | (+++) | (+++) | (++) | (++) |
| BG505gp140.6R.IP.664.T332N_V127C/D157C | - | - | - | - | - | (++) | (++) | (++) | (+++) | - | - |
| BG505gp140.6R.IP.664.T332N_T128C/L165C | - | - | (++) | - | - | (++) | (++) | (++) | (+++) | - | - |
| BG505gp140.6R.IP.664.T332N_G521C/I84C | (+) | (++) | - | (+) | - | (+++) | (+++) | (+) | (+++) | (++) | (++) |

FIG. 42D

| Construct | VRC26 | PGT145 | F105 | 17b + sCD4 | 17b | PGT122 | VRC01 | 447-52D | 447-52D + sCD4 | PGT151 | PGT151+ sCD4+17b |
|---|---|---|---|---|---|---|---|---|---|---|---|
| BG505gp140.6R.SOSIP.664.T332N_A526C/V89C | - | (+) | - | (+) | - | (++) | (++) | (+++) | (+++) | (+) | - |
| BG505gp140.6R.SOSIP.664.T332N_A533C/P43C | - | (+) | - | (+) | - | (++) | (++) | (+++) | (+++) | (+) | - |
| BG505gp140.6R.SOSIP.664.T332N_S546C/A221C | - | (+) | - | (+) | - | (++) | (++) | (+++) | (+++) | (+) | (+) |
| BG505gp140.6R.SOSIP.664.T332N_R585C/G222C | - | - | - | - | - | (+) | (++) | (+++) | (+++) | - | - |
| BG505gp140.6R.SOSIP.664.T332N_S199C/G314C | - | - | - | - | - | (+) | (++) | - | - | - | - |
| BG505gp140.6R.SOSIP.664.T332N_A578C/F53C | (+) | (++) | - | (+) | - | (+++) | (+++) | (+++) | (+++) | (++) | (++) |
| BG505gp140.6R.SOSIP.664.T332N_M530F | (+) | (++) | - | (++) | - | (+++) | (+++) | (+) | (+++) | (+++) | (++) |
| BG505gp140.6R.SOSIP.664.T332N_L165R/I184E | - | - | (++) | (++) | (++) | (++) | (+++) | (+++) | (+++) | (+) | - |
| BG505gp140.6R.SOSIP.664.T332N_D180C/A423C | - | - | - | - | - | (+) | (++) | (+++) | (+++) | - | - |
| BG505gp140.6R.SOSIP.664.T332N_N195C/I423C | - | (+) | - | - | - | (++) | (++) | (++) | (+) | (+) | (+) |
| *BG505gp140.6R.SOSIP.664.T332N_N195C/A433C | (++) | (+++) | - | - | - | (+++) | (+++) | (++) | (++) | (+++) | (+++) |
| *BG505gp140.6R.SOSIP.664.T332N_S195C/A433C | (+++) | (+++) | - | - | - | (+++) | (+++) | (++) | (+++) | (+++) | (+++) |
| BG505gp140.6R.SOSIP.664.T332N_S199C/G431C | - | - | - | - | - | (+) | (+) | (++) | (+++) | - | - |
| BG505gp140.6R.SOSIP.664.T332N_Q203C/Y435C | - | - | - | - | - | - | - | - | - | - | - |
| BG505gp140.6R.SOSIP.664.T332N_A204C/A436C | - | - | - | - | - | (++) | (++) | (+) | (+++) | (+) | - |
| BG505gp140.6R.SOSIP.664.T332N_R298C/I443C | - | - | - | (+) | - | (+) | (++) | (+++) | (+++) | - | - |
| *BG505gp140.6R.SOSIP.664.T332N_R304C/Q440C | (++) | (+++) | - | (++) | - | (+++) | (+++) | - | - | (++) | (+) |
| BG505gp140.6R.SOSIP.664.T332N_E153C/R419C | - | - | - | - | - | (+) | (+) | (++) | (+++) | - | - |
| BG505gp140.6R.SOSIP.664.T332N_D180C/Q422C | - | - | - | - | - | - | - | (++) | (++) | - | - |
| BG505gp140.6R.SOSIP.664.T332N_L193C/I433C | - | - | - | - | - | (+) | (++) | (+++) | (+++) | - | - |
| BG505gp140.6R.SOSIP.664.T332N_T128C/D167C_L523C/T244C | - | - | - | - | - | (+) | (++) | (+++) | (+++) | - | - |
| BG505gp140.6R.SOSIP.664.T332N_L179C/K421C_L523C/T244C | - | - | - | - | - | - | (++) | (+++) | - | - | - |
| BG505gp140.6R.SOSIP.664.T332N_Y318C/P437C_L523C/T244C | - | - | - | - | - | (+) | (+) | (++) | (+++) | - | - |
| BG505gp140.6R.SOSIP.664.T332N_T128C/D167C_K574C/T51C | - | - | - | - | - | (++) | (++) | - | - | - | - |
| BG505gp140.6R.SOSIP.664.T332N_L179C/K421C_K574C/T51C | - | - | - | - | - | - | - | (+++) | (+++) | - | - |
| BG505gp140.6R.SOSIP.664.T332N_Y318C/P437C_K574C/T51C | - | - | - | - | - | (+) | (+) | (++) | - | - | - |
| BG505gp140.6R.SOSIP.664.T332N_F159Y | (+++) | (+++) | - | (++) | - | (+++) | (+++) | (++) | (+++) | (+++) | (+++) |
| BG505gp140.6R.SOSIP.664.T332N_I323Y | (+++) | (+++) | - | (+++) | (+) | (+++) | (+++) | (+++) | (+++) | (+++) | (++) |
| BG505gp140.6R.SOSIP.664.T332N_F159Y_I323Y | (+++) | (+++) | - | (+++) | (+) | (+++) | (+++) | (++) | (+++) | (+++) | (+++) |
| BG505gp140.6R.SOSIP.664.T332N_L544Y | (+++) | (+++) | - | (+++) | - | (+++) | (+++) | (++) | (+++) | (+++) | (++) |
| *BG505gp140.6R.SOSIP.664.T332N_F223W | (++) | (+++) | - | (+) | - | (+++) | (+++) | (++) | (+++) | (+++) | (+++) |
| BG505gp140.6R.SOSIP.664.T332N_L544Y_L537Y | (+++) | (+++) | (+) | (+++) | (+) | (+++) | (+++) | (+++) | (+++) | (+) | - |
| BG505gp140.6R.SOSIP.664.T332N_L544Y_F223W | (++) | (+++) | - | (++) | - | (+++) | (+++) | (+++) | (+++) | (++) | (+) |
| BG505gp140.6R.SOSIP.664.T332N_L537Y_F223W | (+) | (++) | - | (++) | - | (+++) | (+++) | (+++) | (+++) | (++) | (+) |
| BG505gp140.6R.SOSIP.664.T332N_L544Y_L537Y_F223W | (++) | (+++) | - | (++) | - | (+++) | (+++) | (+++) | (+++) | - | - |
| BG505gp140.6R.SOSIP.664.T332N_V580L | (+++) | (+++) | - | (+++) | - | (+++) | (+++) | (++) | (+++) | (+++) | (+++) |
| BG505gp140.6R.SOSIP.664.T332N_V583L | (+++) | (+++) | - | (+++) | - | (+++) | (+++) | (+) | (+++) | (+++) | (+++) |
| BG505gp140.6R.SOSIP.664.T332N_V580L/V583L | (+++) | (+++) | - | (+++) | - | (+++) | (+++) | (++) | (+++) | (+++) | (+++) |
| BG505gp140.6R.SOSIP.664.T332N_W69P | (++) | (+++) | - | (+++) | - | (+++) | | (+++) | (+++) | (++) | (+++) |
| BG505gp140.6R.SOSIP.664.T332N_V68P | (+++) | (+++) | - | (+++) | - | (+++) | | (+++) | (+++) | (+++) | (+++) |
| BG505gp140.6R.SOSIP.664.T332N_T71P | (+++) | (+++) | - | (+++) | - | (+++) | | (+++) | (+++) | (+++) | (+++) |
| BG505gp140.6R.SOSIP.664.T332N_H66C_K207C | (+) | (++) | - | (+) | - | (++) | | (+++) | (++) | (+) | (+++) |
| BG505gp140.6R.SOSIP.664.T332N_A73C_G572C | - | (+) | (+) | (+) | - | (++) | | (++) | (++) | - | (+) |
| BG505gp140.6R.SOSIP.664.T332N_F53C_G575C | (+) | (+) | - | (+) | - | (++) | | (+++) | (+++) | (++) | (++) |
| BG505gp140.6R.SOSIP.664.T332N_V75W | (+++) | (+++) | - | (+++) | (+) | (+++) | | (+++) | (+++) | (+++) | (+++) |
| BG505gp140.6R.SOSIP.664.T332N_V75F | (+++) | (+++) | - | (+++) | (+) | (+++) | | (+++) | (+++) | (+++) | (+++) |
| BG505gp140.6R.SOSIP.664.T332N_V75M | (+++) | (+++) | - | (+++) | (+) | (+++) | | (+++) | (+++) | (+++) | (+++) |
| BG505gp140.6R.SOSIP.664.T332N_V208W | (+++) | (+++) | - | (+++) | (+) | (+++) | | (+++) | (+++) | (+++) | (+++) |
| BG505gp140.6R.SOSIP.664.T332N_V208Y | - | (+) | - | - | - | (+) | | (+++) | (++) | - | - |
| BG505gp140.6R.SOSIP.664.T332N_V208F | (+++) | (+++) | (+) | (+++) | (+) | (+++) | | (+++) | (+++) | (+++) | (+++) |
| BG505gp140.6R.SOSIP.664.T332N_V208M | (+) | (++) | - | (+++) | - | (++) | | (+++) | (+++) | (++) | (+++) |
| BG505gp140.6R.SOSIP.664.T332N_A58C_T77C | (++) | (+++) | - | (+++) | - | (++) | | (+++) | (+++) | (+++) | (+++) |
| BG505gp140.6R.SOSIP.664.T332N_D57C_T77C | (++) | (+++) | - | (+++) | (+) | (+++) | | (+++) | (+++) | (+++) | (+++) |
| BG505gp140.6R.SOSIP.664.T332N_V68C_S209C | (+) | (+) | - | (+) | - | (++) | | (+++) | (+++) | (+) | (+) |
| BG505gp140.6R.SOSIP.664.T332N_N67P | (+++) | (+++) | - | (+++) | - | (+++) | | (+++) | (+++) | (+++) | (+++) |
| BG505gp140.6R.SOSIP.664.T332N_H66P | (+++) | (+++) | - | (+++) | - | (+++) | | (+++) | (+++) | (+++) | (+++) |
| BG505gp140.6R.SOSIP.664.T332N_N67P-H66P | (++) | (+++) | - | (+++) | - | (+++) | | (+++) | (+++) | (+++) | (+++) |
| BG505gp140.6R.SOSIP.664.T332N_A58C-T77C-N67P-H66P | (+) | (+) | - | (++) | - | (+++) | | (+++) | (+++) | (++) | (+++) |

FIG. 42E

| Construct | VRC26 | PGT145 | F105 | 17b + sCD4 | 17b | PGT122 | VRC01 | 447-52D | 447-52D + sCD4 | PGT151 | PGT151+ sCD4+17b |
|---|---|---|---|---|---|---|---|---|---|---|---|
| BG505gp140.6R.SOSIP.664.T332N_D57C-T77C-N67P-H66P | (+) | (++) | - | (+++) | - | (+) |  | (+++) | (+++) | (++) | (++) |
| BG505gp140.6R.SOSIP.664.T332N_V68C-S209C-N67P-H66P | - | (+) | - | (+) | - | (+) |  | (+++) | (++) | - | (+) |
| BG505gp140.6R.SOSIP.664.T332N_D474A-R476A | (+) | (+) | - | (+) | - | (++) |  | (+++) | (+++) | (++) | (+) |
| BG505gp140.6R.SOSIP.664.T332N_W112I | (+++) | (+++) | - | (+++) | - | (+++) |  | (+++) | (+++) | (+++) | (+++) |
| BG505gp140.6R.SOSIP.664.T332N_W112M | (+++) | (+++) | - | (+++) | - | (+++) |  | (+++) | (+++) | (+++) | (+++) |
| BG505gp140.6R.SOSIP.664.T332N_W427I | (++) | (+++) | - | (+) | - | (+++) |  | (+++) | (++) | (+++) | (+++) |
| BG505gp140.6R.SOSIP.664.T332N_W427M | (+++) | (+++) | - | (+++) | - | (+++) |  | (+++) | (+++) | (+++) | (+++) |
| BG505gp140.6R.SOSIP.664.T332N_R429N | (+++) | (+++) | - | (+++) | (+) | (+++) |  | (+++) | (+++) | (+++) | (+++) |
| BG505gp140.6R.SOSIP.664.T332N_R429L | (++) | (+++) | - | (+++) | - | (+++) |  | (+++) | (+++) | (+++) | (+++) |
| BG505gp140.6R.SOSIP.664.T332N_R429L-W427M | (++) | (+++) | - | - | - | (+++) |  | (+++) | (++) | (+++) | (+++) |
| BG505gp140.6R.SOSIP.664.T332N_D474A | (+) | (+) | - | (++) | (+) | (++) |  | (+++) | (+++) | (+) | (++) |
| BG505gp140.6R.SOSIP.664.T332N_R476A | (+) | (++) | - | (++) | - | (++) |  | (+++) | (+++) | (++) | (++) |
| BG505gp140.6R.SOSIP.664.T332N_I201C/A433C_F159Y | (+++) | (+++) | - | - | - | (+++) |  | (+++) | (+++) | (+++) | (+++) |
| BG505gp140.6R.SOSIP.664.T332N_R166CG/V127C | - | - | - | - | - | (++) |  | (+++) | (++) | - | - |
| BG505gp140.6R.SOSIP.664.T332N_K421W_D180L | - | - | - | - | - | (+) |  | (++) | (++) | - | - |
| BG505gp140.6R.SOSIP.664.T332N_G431GC_S199C | (++) | (++) | - | - | - | (+++) |  | (+++) | (+++) | (++) | (+++) |
| BG505gp140.6R.SOSIP.664.T332N_166C_127SC | - | - | - | (++) | (+) | (+++) |  | (+++) | (+++) | (+) | (+) |
| BG505gp140.6R.SOSIP.664.T332N_G312C/S199C | - | - | - | - | - | (+) |  | - | - | - | - |
| BG505gp140.6R.SOSIP.664.T332N_S199C_G312CG | - | (+) | - | - | - | (+) |  | - | - | - | - |
| BG505gp140.6R.SOSIP.664.T332N_V120W | (+++) | (+++) | - | (++) | (++) | (+++) |  | (+++) | (+++) | (+++) | (++) |
| BG505gp140.6R.SOSIP.664.T332N_120W_203V | (++) | (+) | (+) | (+) | - | (+++) |  | (+++) | (+++) | (+) | (+) |
| BG505gp140.6R.SOSIP.664.T332N_Delta-P124 | - | (+) | - | (++) | (++) | (+) |  | (+++) | (+++) | (++) | (+) |
| BG505gp140.6R.SOSIP.664.T332N_L125W_Delta-P124 | - | - | - | (+) | (+) | (++) |  | (++) | (++) | - | - |
| BG505gp140.6R.SOSIP.664.T332N_151E+153W+328W | - | (+) | - | (+) | - | (+) |  | (+++) | (++) | - | - |
| BG505gp140.6R.SOSIP.664.T332N_159W | (+) | (++) | - | (+++) | (+++) | (+++) |  | (+++) | (+++) | (+++) | (+++) |
| BG505gp140.6R.SOSIP.664.T332N_316W | (++) | (+++) | - | (+++) | (+) | (+++) |  | (+++) | (+++) | (+++) | (+++) |
| BG505gp140.6R.SOSIP.664.T332N_161W | - | (+) | (+) | (++) | (++) | (+) |  | (+++) | (++) | (+) | - |
| BG505gp140.6R.SOSIP.664.T332N_I309W | (+++) | (+++) | - | (+++) | (++) | (+++) |  | (+) | (++) | (+++) | (+++) |
| BG505gp140.6R.SOSIP.664.T332N_125R_316D | - | - | - | (++) | (+) | (++) |  | (+++) | (+++) | - | - |
| BG505gp140.6R.SOSIP.664.T332N_125E_316R | - | - | (+) | (++) | (++) | (++) |  | (++) | (++) | - | - |
| BG505gp140.6R.SOSIP.664.T332N_S115W | (+++) | (+++) | (+) | (+++) | (+) | (+++) |  | (+++) | (+++) | (+++) | (+++) |
| BG505gp140.6R.SOSIP.664.T332N_P118W | (++) | (+++) | - | (+++) | (+) | (+++) |  | (+++) | (+++) | (+++) | (+++) |
| BG505gp140.6R.SOSIP.664.T332N_Delta_P206 | (+++) | (+++) | - | (++) | - | (+++) |  | (+++) | (+++) | (+++) | (+++) |
| BG505gp140.6R.SOSIP.664.T332N_A70Y | (+++) | (+++) | - | (+++) | (+) | (+++) |  | (+++) | (+++) | (+++) | (+++) |
| BG505gp140.6R.SOSIP.664.T332N_A70F | (+++) | (+++) | - | (+++) | (+) | (+++) |  | (+++) | (+++) | (+++) | (+++) |
| BG505gp140.6R.SOSIP.664.T332N_L111Y | (+++) | (+++) | - | (+++) | - | (+++) |  | (+++) | (+++) | (+++) | (+++) |
| BG505gp140.6R.SOSIP.664.T332N_L111F | (+++) | (+++) | - | (+++) | (+) | (+++) |  | (+++) | (+++) | (+++) | (+++) |
| BG505gp140.6R.SOSIP.664.T332N_T203P | (+++) | (++) | (+) | (+++) | (+++) | (+++) |  | (+++) | (+++) | (+++) | (+++) |
| BG505gp140.6R.SOSIP.664.T332N_V120T | (+++) | (+++) | - | (+++) | (++) | (+++) |  | (+++) | (+++) | (+++) | (+++) |
| BG505gp140.6R.SOSIP.664.T332N_L122K | - | - | (+) | (++) | (+) | (++) |  | (+++) | (+++) | - | - |
| BG505gp140.6R.SOSIP.664.T332N_P313C_A200C_T51C_K574C | - | - | - | - | - | (+) |  | - | - | - | - |
| BG505gp140.6R.SOSIP.664.T332N_P313C_A200C_F53C_K574C | - | - | - | - | - | (+) |  | - | - | - | - |
| BG505gp140.6R.SOSIP.664.T332N_P313C_A200C_T51C_A576C | - | - | - | - | - | (+) |  | - | - | - | - |
| BG505gp140.6R.SOSIP.664.T332N_I573T | (+++) | (+++) | - | (+++) | (+) | (+++) |  | (+++) | (+++) | (+++) | (+++) |
| BG505gp140.6R.SOSIP.664.T332N_G594N | (+++) | (+++) | - | (+++) | (+) | (+++) |  | (+++) | (+++) | (+++) | (+++) |
| BG505gp140.6R.SOSIP.664.T332NI573T-G594N | (+++) | (+++) | - | (+++) | (+) | (+++) |  | (+++) | (+++) | (+++) | (+++) |
| BG505gp140.6R.SOSIP.664.T332NI573T-G594N-K574E | (+++) | (+++) | - | (+++) | (+) | (+++) |  | (+++) | (+++) | (+++) | (+++) |
| BG505gp140.6R.SOSIP.664.T332NI573T-G594N-K574T | (+++) | (+++) | - | (+++) | (+) | (+++) |  | (+++) | (+++) | (+++) | (+++) |
| BG505gp140.6R.SOSIP.664.T332N_Q428C_A561C | - | (+) | - | - | - | (+) |  | (++) | (++) | - | (+) |
| BG505gp140.6R.SOSIP.664.T332N_Q428C_Q563C | - | (+) | - | - | - | (+) |  | (+++) | (++) | - | - |
| BG505gp140.6R.SOSIP.664.T332N_K574C_D107C | - | - | - | (+) | - | (++) |  | (+++) | (+++) | - | - |
| BG505gp140.6R.SOSIP.664.T332N_Q575C_Q550C | (+) | (++) | - | (+++) | (++) | (++) |  | (+++) | (+++) | (++) | (++) |
| BG505gp140.6R.SOSIP.664.T332N_Q575C_Q551C | (+) | (++) | - | (+++) | (+) | (+++) |  | (+++) | (+++) | (++) | (++) |
| BG505gp140.6R.SOSIP.664.T332N_Q575C_Q550C | - | (+) | - | (++) | (+) | (++) |  | (+++) | (+++) | - | - |
| BG505gp140.6R.SOSIP.664.T332N_K117W | (++) | (++) | - | (+++) | - | (++) |  | (+++) | (+++) | (++) | (++) |
| BG505gp140.6R.SOSIP.664.T332N_K121E | (+) | - | - | (+++) | - | (+++) |  | (+++) | (+++) | - | - |
| BG505gp140.6R.SOSIP.664.T332N_S110W | (++) | (++) | - | (+++) | (+) | (++) |  | (+++) | (+++) | (++) | (++) |
| BG505gp140.6R.SOSIP.664.T332N_P220W | - | (+) | - | (+) | - | (++) |  | (+++) | (+++) | - | - |

FIG. 42F

| Construct | VRC26 | PGT145 | F105 | 17b + sCD4 | 17b | PGT122 | VRC01 | 447-52D | 447-52D + sCD4 | PGT151 | PGT151+ sCD4+17b |
|---|---|---|---|---|---|---|---|---|---|---|---|
| BG505gp140.6R.SOSIP.664.T332N_T50W | - | (+) | - | (++) | (+) | (++) | | (+++) | (+++) | (+) | (+) |
| BG505gp140.6R.SOSIP.664.T332N_V120W_I201C_A433C | (++) | (+) | - | - | - | (+++) | | (+++) | (++) | (++) | (++) |
| BG505gp140.6R.SOSIP.664.T332N_K117W_I201C_A433C | (+) | (++) | - | - | - | (++) | | (+++) | (++) | (+) | (++) |
| BG505gp140.6R.SOSIP.664.T332N_K121E_I201C_A433C | - | - | - | - | - | (+++) | | (+++) | (+++) | (++) | (+++) |
| BG505gp140.6R.SOSIP.664.T332N_M426W_I201C_A433C | (++) | (++) | - | - | - | (+++) | | (+++) | (++) | (++) | (+++) |
| BG505gp140.6R.SOSIP.664.T332N_S110W_I201C_A433C | (+) | (++) | - | - | - | (++) | | (+++) | (++) | (++) | (++) |
| BG505gp140.6R.SOSIP.664.T332N_Q114W_I201C_A433C | (++) | (++) | - | - | - | - | | (+++) | (++) | (+++) | (+++) |
| BG505gp140.6R.SOSIP.664.T332N_P220W_I201C_A433C | - | (+) | - | - | - | (+) | | (+++) | (++) | - | - |
| BG505gp140.6R.SOSIP.664.T332N_R429W_I201C_A433C | (++) | (++) | - | - | - | (++) | | (+++) | (++) | (++) | (++) |
| BG505gp140.6R.SOSIP.664.T332N_GGSGSGG_N_3HSH | (++) | (+++) | (++) | (+++) | - | (+++) | | (++) | (+++) | (+++) | (+) |
| BG505gp140.6R.SOSIP.664.T332N_GG_C_3HSH | (++) | (+++) | (+) | (+++) | - | (+++) | | (+) | (+++) | (+++) | (+) |
| BG505gp140.6R.SOSIP.664.T332N_Q432E | (+++) | (+++) | - | (+++) | - | (+++) | | (+) | (+++) | (++) | - |
| BG505gp140.6R.SOSIP.664.T332N_Q432D | (+++) | (+++) | - | (+) | - | (+++) | | (+) | (++) | (++) | - |
| BG505gp140.6R.SOSIP.664.T332N_M434P | - | - | (++) | - | - | (+) | | (++) | (++) | - | - |
| BG505gp140.6R.SOSIP.664.T332N_Y435P | - | - | (++) | - | - | (+) | | (++) | (++) | - | - |
| BG505gp140.6R.SOSIP.664.T332N_A436P | - | - | (++) | (+) | (+) | (+) | | (++) | (++) | - | - |
| BG505gp140.6R.SOSIP.664.T332N_P437A | (+++) | (+++) | (++) | (+++) | - | (+++) | | (+) | (+++) | (++) | - |
| BG505gp140.6R.SOSIP.664.T332N_P438A | (+++) | (+++) | - | (+++) | - | (+++) | | (+) | (+++) | (++) | (+) |
| BG505gp140.6R.SOSIP.664.T332N_P438A.P437A | (+) | - | - | (+) | - | (+) | | - | (+) | - | - |
| BG505gp140.6R.SOSIP.664.T332N_T139W_I326R | (++) | (+++) | (+) | (++) | - | (+++) | | (++) | (+++) | (+) | - |
| BG505gp140.6R.SOSIP.664.T332N_L179W | (++) | (+++) | (++) | (+++) | - | (+++) | | (+) | (+++) | (+++) | (+++) |
| BG505gp140.6R.SOSIP.664.T332N_Y39F.S534V | (++) | (+++) | - | (++) | - | (+++) | | (+) | (++) | (+++) | (+) |
| BG505gp140.6R.SOSIP.664.T332N_Y39W.S534A | (++) | (+++) | - | (+++) | - | (+++) | | (+) | (+++) | (++) | - |
| BG505gp140.6R.SOSIP.664.T332N_Y39F.S534V.T37V.T | - | - | - | (+) | - | (+) | | (+) | (+) | - | - |
| BG505gp140.6R.SOSIP.664.T332N_Y39F.Y40F.S534V.T | - | - | - | - | - | (+) | | (+) | (+) | - | - |
| BG505gp140.6R.SOSIP.664.T332N_T319C_P438C | (+) | (+++) | - | - | - | (+++) | | - | - | (++) | (+) |
| BG505gp140.6R.SOSIP.664.T332N_N425C_I430C | (++) | (+++) | - | - | - | (+++) | | (+) | (+) | (+) | (+) |
| BG505gp140.6R.SOSIP.664.T332N_Y317C_P437C_G473A | (+) | (+) | - | - | - | (+) | | - | - | - | - |
| BG505gp140.6R.SOSIP.664.T332N_M426W | (+++) | (+++) | (++) | (+) | - | (+++) | | (+) | (+) | (+++) | - |
| BG505gp140.6R.SOSIP.664.T332N_S174C_A318C_G473A | (+) | (+++) | - | - | - | (+++) | | - | - | (++) | - |
| BG505gp140.6R.SOSIP.664.T332N_L175C_T319C_G473A | - | - | - | - | - | - | | - | - | - | - |
| BG505gp140.6R.SOSIP.664.T332N_P176C_D180C | - | - | (++) | - | - | (+) | | (++) | (++) | - | - |
| BG505gp140.6R.SOSIP.664.T332N_A204C_A436C_G473A | - | - | - | - | - | (+) | | (+) | (+) | - | - |
| BG505gp140.6R.SOSIP.664.T332N_A204C_M434C_G473A | - | - | - | - | - | (++) | | (++) | (+) | - | - |
| BG505gp140.6R.SOSIP.664.T332N_P212C_K252C | (+) | (++) | - | (+) | - | (++) | | (++) | (++) | (+) | - |
| BG505gp140.6R.SOSIP.664.T332N_P230C_A200C | - | - | - | - | - | - | | (++) | (++) | - | - |
| BG505gp140.6R.SOSIP.664.T332N_G313C_A200C | - | - | - | - | - | (+) | | - | - | - | - |
| BG505gp140.6R.SOSIP.664.T332N_A204C_M434C | - | - | - | - | - | (++) | | (++) | (++) | - | - |
| BG505gp140.6R.SOSIP.664.T332N_L122C_L175C | - | - | (+++) | - | - | (++) | | (++) | (+) | - | - |
| BG505gp140.6R.SOSIP.664.T332N_G473A | (++) | (+++) | - | - | - | (+++) | | (+) | (+) | (+++) | (+) |
| BG505gp140.6R.SOSIP.664.T332N_G473S | (++) | (+++) | - | - | - | (+++) | | (+) | (+) | (+++) | (+) |
| BG505gp140.6R.SOSIP.664.T332N_G473Y | (+++) | (+++) | - | - | - | (+++) | | (+) | (+) | (++) | (+) |
| BG505gp140.6R.SOSIP.664.T332N_G431P | (+++) | (+++) | - | - | - | (+++) | | (++) | (++) | (++) | - |
| BG505gp140.6R.SOSIP.664.T332N_N425C_A433C | (+++) | (+++) | - | - | - | (+++) | | (+) | (+) | (++) | (+) |
| BG505gp140.6R.SOSIP.664.T332N_V120C_Q315C | (+++) | (+++) | - | - | - | (+++) | | - | - | (+) | (+) |
| BG505gp140.6R.SOSIP.664.T332N_P124C_T164C | - | - | - | (+) | - | (++) | | (++) | (++) | - | - |
| BG505gp140.6R.SOSIP.664.T332N_T128C_T167C_G473A | - | - | - | - | - | (+) | | (+) | (+) | - | - |
| BG505gp140.6R.SOSIP.664.T332N_I424C_F382C | - | - | - | - | - | (+) | | (++) | (++) | - | - |
| BG505gp140.6R.SOSIP.664.T332N_R298C_A329C | (+) | - | (++) | (++) | (+) | (+) | | (++) | (++) | (+) | - |
| BG505gp140.6R.SOSIP.664.T332N_M426P | (+++) | (+++) | - | (+) | - | (+++) | | (++) | (+++) | (++) | (+) |
| BG505gp140.6R.SOSIP.664.T332N_Y191W_G473A | (+++) | (+++) | - | - | - | (+++) | | (+) | (+) | (++) | (+) |
| BG505gp140.6R.SOSIP.664.T332N_Q203C_L122C | (+++) | (+++) | (+++) | - | - | (+++) | | (++) | (+++) | (+) | - |
| BG505gp140.6R.SOSIP.664.T332N_M426A | (++) | (+++) | - | (++) | - | (+++) | | (++) | (+++) | (++) | (+) |
| BG505gp140.6R.SOSIP.664.T332N_Y191W_A433P | (+++) | (+++) | (++) | - | - | (+++) | | (+) | (++) | (+) | - |
| BG505gp140.6R.SOSIP.664.T332N_T372C_S364C | (++) | (+++) | - | (+) | - | (+++) | | (+) | (++) | (+) | - |
| BG505gp140.6R.SOSIP.664.T332N_V36C_V606C | - | - | (++) | - | - | (+) | | (+) | (+) | - | - |
| BG505gp140.6R.SOSIP.664.T332N_M426F | (+++) | (+++) | - | (+) | - | (+++) | | (+) | (++) | (++) | (++) |
| BG505gp140.6R.SOSIP.664.T332N_I201C/A433C/R304C/Q440C | (+) | (++) | - | - | - | - | | - | - | - | - |

FIG. 42G

| Construct | VRC26 | PGT145 | F105 | 17b + sCD4 | 17b | PGT122 | VRC01 | 447-52D | 447-52D + sCD4 | PGT151 | PGT151+ sCD4+17b |
|---|---|---|---|---|---|---|---|---|---|---|---|
| BG505gp140.6R.SOSIP.664.T332N_I201C/A433C/F223W | (++) | (++) | - | - | - | | | (+) | (±) | | |
| BG505gp140.6R.SOSIP.664.T332N_I201C/A433C/F159Y | (+++) | (+++) | - | - | - | | | (++) | (+) | | |
| BG505gp140.6R.SOSIP.664.T332N_I201C/A433C/V580L | (+++) | (+++) | - | - | - | | | (+) | (+) | | |
| BG505gp140.6R.SOSIP.664.T332N_I201C/A433C/S174C/A318C | - | (++) | - | - | - | | | - | - | | |
| BG505gp140.6R.SOSIP.664.T332N_S199C/A433C/S174C/A318C | - | (+) | - | - | - | | | - | - | | |
| BG505gp140.6R.SOSIP.664.T332N_S199C/A433C/R304C/Q440C | (+) | (++) | - | - | - | | | - | - | | |
| BG505gp140.6R.SOSIP.664.T332N_S199C/A433C/F223W | (+) | (++) | - | - | - | | | (+) | (±) | | |
| BG505gp140.6R.SOSIP.664.T332N_S199C/A433C/F159Y | (+++) | (+++) | - | - | - | | | (+) | (++) | | |
| BG505gp140.6R.SOSIP.664.T332N_S199C/A433C/V580L | (++) | (+++) | - | - | - | | | (+) | (++) | | |
| BG505gp140.6R.SOSIP.664.T332N_N195C/A433C/R304C/Q440C | - | (+) | - | - | - | | | - | - | | |
| BG505gp140.6R.SOSIP.664.T332N_N195C/A433C/S174C/A318C | - | - | - | - | - | | | - | - | | |
| BG505gp140.6R.SOSIP.664.T332N_N195C/A433C/F223W | - | (+) | - | - | - | | | (+) | (+) | | |
| BG505gp140.6R.SOSIP.664.T332N_N195C/A433C/F159Y | (+++) | (++) | - | - | - | | | (+) | (+) | | |
| BG505gp140.6R.SOSIP.664.T332N_N195C/A433C/V580L | (+) | (+++) | - | - | - | | | (+) | (+) | | |
| BG505gp140.6R.SOSIP.664.T332N_A98C/W610C | - | - | (+++) | (+) | (++) | | | (++) | (++) | | |
| BG505gp140.6R.SOSIP.664.T332N_G527C/N88C | - | - | - | - | (+) | | | (+) | (++) | | |
| BG505gp140.6R.SOSIP.664.T332N_Q540C/P43C | - | - | - | - | (+) | | | (+) | (++) | | |
| BG505gp140.6R.SOSIP.664.T332N_E164C/N197C | - | - | (+) | - | - | | | (++) | (++) | | |
| BG505gp140.6R.SOSIP.664.T332N_P124C/R166C | - | - | - | - | - | | | (++) | (++) | | |
| BG505gp140.6R.SOSIP.664.T332N_T320C/P438C | (+) | (++) | - | - | - | | | - | - | | |
| BG505gp140.6R.SOSIP.664.T332N_D180C/K421C | - | - | - | - | - | | | (+) | (+) | | |
| BG505gp140.6R.SOSIP.664.T332N_F176W_I322Y | (+) | (+) | (++) | (+) | (+++) | | | (++) | (+++) | | |
| BG505gp140.6R.SOSIP.664.T332N_F176W_L154W | (+) | (+) | (++) | - | (+++) | | | (++) | (+++) | | |
| BG505gp140.6R.SOSIP.664.T332N_F159Y_L154W | (+++) | (+++) | - | - | (+++) | | | (+) | (+++) | | |
| BG505gp140.6R.SOSIP.664.T332N_L537Y | (++) | (+++) | (+) | - | (+++) | | | (++) | (+++) | | |
| BG505gp140.6R.SOSIP.664.T332N_L523F | - | - | - | - | - | | | - | - | | |
| BG505gp140.6R.SOSIP.664.T332N_F522Y | - | - | - | - | - | | | - | - | | |
| BG505gp140.6R.SOSIP.664.T332N_W35Q | - | - | - | - | - | | | - | - | | |
| BG505gp140.6R.SOSIP.664.T332N_A200C/P313C_A221C/A582C | - | - | - | - | - | | | - | - | | |
| BG505gp140.6R.SOSIP.664.T332N | (+++) | (+++) | - | (+++) | - | (+++) | (+++) | (+++) | (+++) | (+++) | (+++) |

FIG. 43

| Construct | VRC26 | PGT145 | F105 | 17b + sCD4 | 17b | PGT122 | VRC01 | 447-52D | 447-52D + sCD4 | PGT151 | PGT151+ PGT121+ sCD4+17b |
|---|---|---|---|---|---|---|---|---|---|---|---|
| *BG505.SOSIP-ferritin | (+) | (++) | | (++) | | (++) | | | | (++) | |
| *BG505.SOSIP-LS | (++) | (++) | | (++) | | (++) | | | | (++) | |
| BG505.SOSIP_3bve_ferr.24_15h | (+) | (+) | | (++) | | (++) | | | | (++) | |
| BG505.SOSIP_1hqk_ls-60_15h | | | | (++) | | (++) | | | | (++) | |
| *BG505.SOSIP_1qbe_bph-qB-180_15h | (++) | (++) | | (++) | | (++) | | | | (++) | |
| *BG505.SOSIP_2vf9_bph-prr1-180_15h | (+) | (++) | | (++) | | (++) | | | | (++) | |
| *BG505.SOSIP_1gav_bph-ga-180_15h | (++) | (++) | | (++) | | (++) | | | | (++) | |
| *BG505.SOSIP_2w4y_bph-5-180_15h | (++) | (+++) | | (++) | | (++) | | | | (+++) | |
| *BG505.SOSIP_1frs_bph-fr-180_15h | (+++) | (+++) | | (+++) | | (+++) | | | | (+++) | |
| *BG505.SOSIP_1mva_ph-ms2-180_15h | (++) | (+++) | | (+++) | | (+++) | | | | (+++) | |
| BG505.SOSIP_2tbv_tcm-v-180_15h | - | - | | - | | - | | | | - | |
| BG505.SOSIP_2tbv_tcm-v-180_7h | - | - | | - | | (±) | | | | - | |
| BG505.SOSIP_1smv_sesb-mv-180_7h | - | - | | (±) | | (±) | | | | (±) | |
| BG505.SOSIP_1f2n_rice-ymv-180_7h | - | - | | (±) | | (±) | | | | (±) | |
| BG505.SOSIP_1ng0_cfmv-180_5h | - | - | | (±) | | (±) | | | | - | |
| BG505.SOSIP_1ohg_bph-hk97-420_3h | - | - | | (++) | | (++) | | | | - | |
| BG505.SOSIP_1ohg_bph-hk97-420_1h | - | - | | (++) | | (++) | | | | - | |
| BG505.SOSIP_2wqt_mhpd-60_15h | - | - | | (++) | | (++) | | | | - | |
| BG505.SOSIP_2wqt_mhpd-60_5h | - | - | | (++) | | (++) | | | | - | |
| BG505.SOSIP_2wqt_mhpd-60_3h | - | - | | (++) | | (++) | | | | - | |
| BG505.SOSIP_2wqt_mhpd-60_1h | - | - | | (++) | | (++) | | | | - | |
| BG505.SOSIP_1smv_sesb-mv-180_15h | - | - | | - | | - | | | | - | |
| BG505.SOSIP_1ng0_cfmv-180_15h | - | - | | - | | - | | | | - | |
| BG505.SOSIP_1f2n_rice-ymv-180_15h | - | - | | - | | - | | | | - | |
| BG505.SOSIP_1ohg_bph-hk97-420_15h | - | - | | (±) | | (±) | | | | (±) | |

FIG. 44

| Construct | VRC26 | PGT145 | F105 | 17b + sCD4 | 17b | PGT122 | VRC01 | 447-52D | 447-52D + sCD4 | PGT151 | PGT151 + sCD4 + 17b |
|---|---|---|---|---|---|---|---|---|---|---|---|
| 25925_bg505-NCgp120+gp41.SOSIP+int | (+++) | (+++) | - | (++) | | | | | | (+++) | |
| 3301_bg505-NCgp120+gp41.SOSIP_A433P | (+++) | (++) | (+++) | (++) | | | | | | (+++) | |
| 3301_bg505-NCgp120+gp41.SOSIP_ds | (+++) | (+) | - | - | | | | | | (+++) | |
| 3301_bg505-NCgp120+gp41.SOSIP_Q432P | (+++) | (++) | (+) | (+++) | | | | | | (+++) | |
| 3301_bg505-NCgp120+gp41.SOSIP_R46K | (+++) | (+) | (+) | (+++) | | | | | | (+++) | |
| 3301_bg505-NCgp120+gp41.SOSIP+int_ds | (+++) | (+) | - | - | | | | | | (+++) | |
| 3301_gp120_BG505-gp41+gp120NCterm+int | (+++) | (+) | - | (+++) | | | | | | (+++) | |
| CAP256-SU_bg505-NCgp120+gp41.SOSIP_A433P | (+++) | (++) | (+++) | (++) | | | | | | (++) | |
| CAP256-SU_bg505-NCgp120+gp41.SOSIP_A433P | (+++) | (++) | (+++) | (+++) | | | | | | (+) | |
| CAP256-SU_bg505-NCgp120+gp41.SOSIP_ds | (+++) | (++) | - | (+) | | | | | | (+++) | |
| CAP256-SU_bg505-NCgp120+gp41.SOSIP_Q432P | (+++) | (++) | (+++) | (+++) | | | | | | (+) | |
| CAP256-SU_bg505-NCgp120+gp41.SOSIP_R46K | (+++) | (++) | (+) | (+++) | | | | | | (+) | |
| CAP256-SU_bg505-NCgp120+gp41.SOSIP+int | (+++) | (++) | - | (+++) | | | | | | (+++) | |
| CAP256-SU_gp120_BG505-gp41+gp120NCterm+int_ds | (+++) | (++) | (+) | - | | | | | | (+++) | |
| CH117.4-gp120_BG505-gp41+gp120NCterm+int | (+++) | (++) | - | (+) | | | | | | (+++) | |
| CNE58-SUstrandC_bg505-NCgp120+gp41.SOSIP_432P | (+++) | (++) | - | - | | | | | | (+++) | |
| CNE58-SUstrandC_bg505-NCgp120+gp41.SOSIP_433P | (+++) | (+++) | - | - | | | | | | (+++) | |
| CNE58-SUstrandC_bg505-NCgp120+gp41.SOSIP_ds201-433 | (+++) | (+++) | - | - | | | | | | (+++) | |
| CNE58-SUstrandC_bg505-NCgp120+gp41.SOSIP_ds304-440 | (+++) | (++) | - | - | | | | | | (+++) | |
| KER2018_bg505-NCgp120+gp41.SOSIP | (+++) | (++) | (+++) | (+++) | | | | | | (+) | |
| KER2018_bg505-NCgp120+gp41.SOSIP+int | (+++) | (++) | (+++) | (+++) | | | | | | (+) | |
| ZM233_bg505-NCgp120+gp41.SOSIP_ds | (+) | (+) | - | - | | | | | | - | |
| ZM233_bg505-NCgp120+gp41.SOSIP_R46K | (++) | (++) | - | (+++) | | | | | | - | |
| ZM233_bg505-NCgp120+gp41.SOSIP+int | (+++) | (++) | - | (+++) | | | | | | (+) | |
| ZM53_bg505-NCgp120+gp41.SOSIP_A433P | (+++) | (++) | (++) | (++) | | | | | | (++) | |
| ZM53_bg505-NCgp120+gp41.SOSIP_ds | (+++) | (+) | - | - | | | | | | (++) | |
| ZM53_bg505-NCgp120+gp41.SOSIP_Q432P | (+++) | (++) | (+++) | (++) | | | | | | (++) | |
| ZM53_bg505-NCgp120+gp41.SOSIP_R46K | (+++) | (+) | - | (+++) | | | | | | (++) | |
| ZM53_bg505-NCgp120+gp41.SOSIP+int | (+++) | (+) | - | (+++) | | | | | | (++) | |
| ZM53-gp120_BG505-gp41+gp120NCterm+int_D7324_ds | (+++) | (+) | - | - | | | | | | (++) | |
| BG505SOSIP-D7324 | (+++) | (+++) | - | (+++) | | | | | | (+++) | |

Variable Env molecule

BG505 SOSIP gp41 and N/C termini

Top view   Side view   Heterologous gp120

BG505 "Platform"

Heterologous gp120
BG505 (gp41 + gp120-NC (residues 31-45; 478-507))

FIG. 50
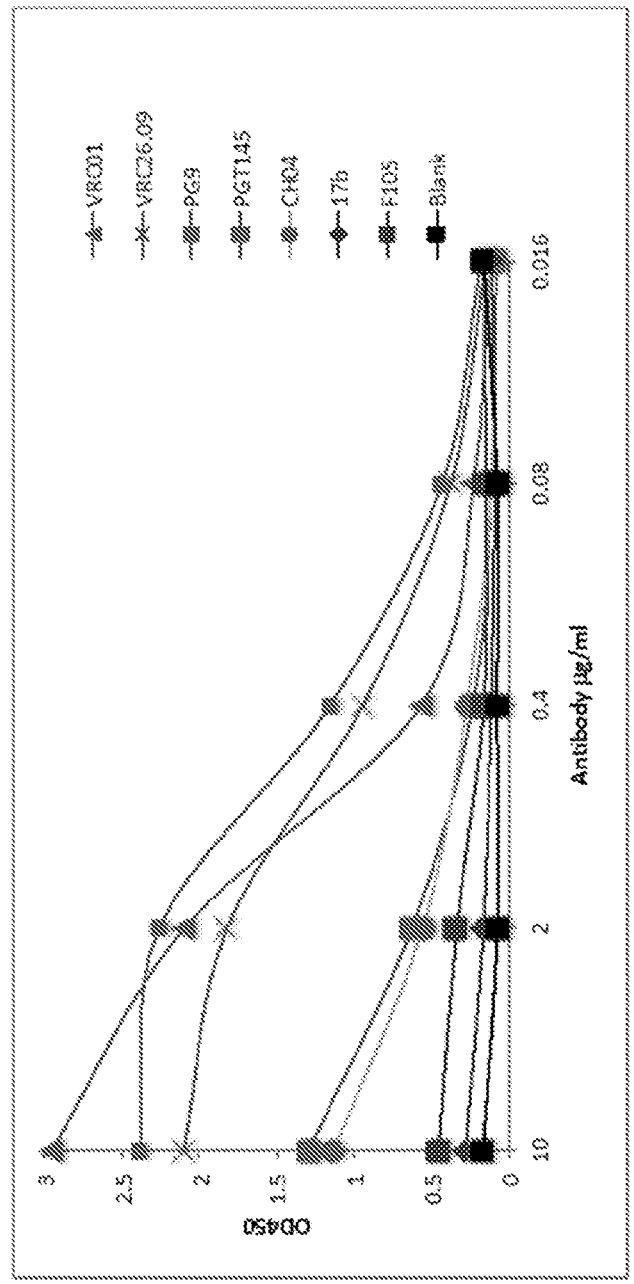
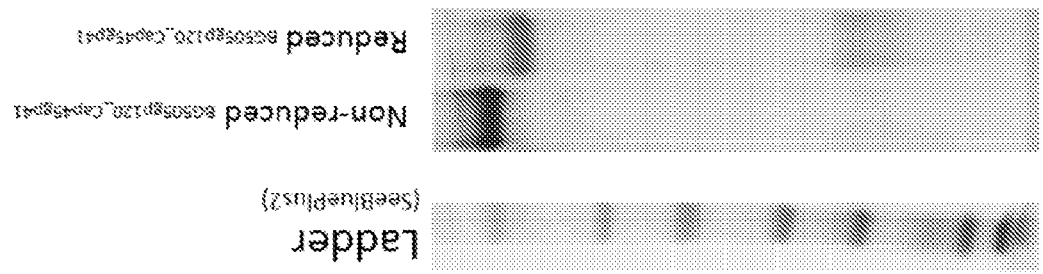

FIG. 52
CNE58-strandC-chimera
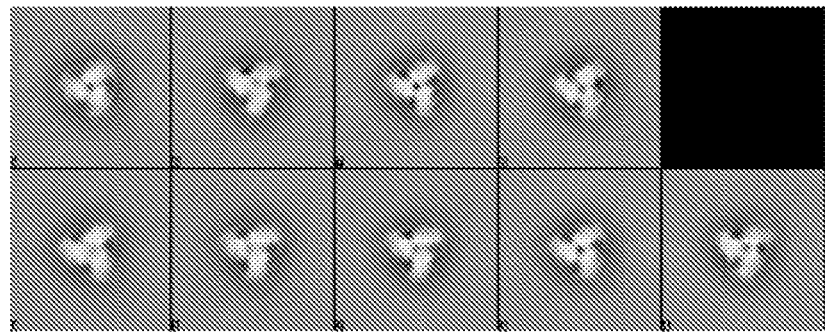
CAP256 SU chimera
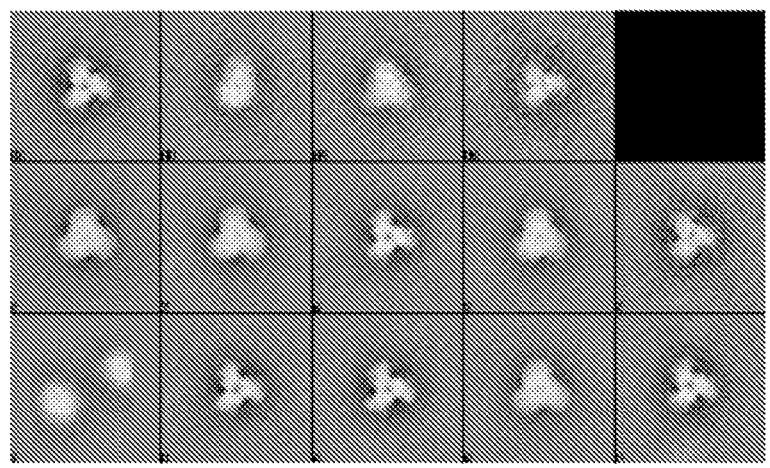
3301_V1_C24_bg505-chimera
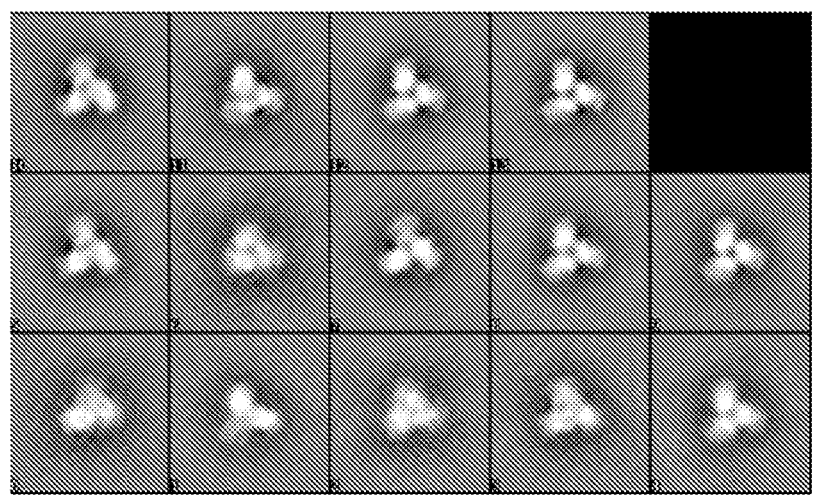

FIG. 53A

| SEQ ID NO | Name | VRC26 | PGT 145 | F105 | 17b | 17b+ CD4 | PGT 151 | 35O22 | PGT 122 | 447-52D | VRC 01 | ScoreA | ScoreB |
|---|---|---|---|---|---|---|---|---|---|---|---|---|---|
| | Media | 0.14 | 0.3 | 0.21 | 0.12 | 0.15 | 0.23 | 0.26 | 0.29 | 0.21 | 0.32 | -0.7 | 0.14 |
| | Media | 0.19 | 0.3 | 0.21 | 0.1 | 0.14 | 0.19 | 0.29 | 0.31 | 0.21 | 0.37 | -0.7 | 0.19 |
| | sosip_ig_I201C/A433C | 2.29 | 2.01 | 0.6 | 0.05 | 0.08 | 2.77 | 2.72 | 2.73 | 2.7 | 3.06 | 1.29 | 2.27 |
| | BG505SOSIP-D7324 | 2.16 | 2.28 | 0.88 | 1.35 | 2.46 | 2.76 | 2.86 | 2.93 | 2.73 | 3.08 | 1.28 | 1.04 |
| | BG505gp120, T332N,D7324 | 0.07 | 1.33 | 1.45 | 0.88 | 1.94 | 0.14 | 0.07 | 3.15 | 2.94 | 3.14 | -1.8 | -3.3 |
| 1075 | ZM106.9.sosip_d7324.201C-433C[1] | 2.92 | 2.87 | 0.52 | 0.06 | 0.05 | 0.13 | 2.78 | 3.01 | 2.53 | 2.6 | 1.92 | 2.92 |
| 1025 | ZM106.9-chim_d7324.201C-433C[1] | 2.88 | 2.73 | 0.52 | 0.06 | 0.07 | 2.81 | 1.68 | 2.8 | 2.37 | 2.79 | 1.88 | 2.88 |
| 938 | CH038.12-chim_d7324.201C-433C[1] | 2.87 | 1.95 | 0.27 | 0.05 | 0.08 | 2.64 | 0.95 | 3.01 | 2.83 | 2.85 | 1.87 | 2.87 |
| 872 | 16055-2.3-chim_d7324.201C-433C[1] | 2.76 | 0.62 | 0.58 | 0.06 | 0.08 | 1.29 | 2.15 | 1.46 | 2.36 | 2.61 | 1.76 | 2.76 |
| 1098 | ZM55.28a-chim-sc_d7324.201C-433C[3] | 2.77 | 1.05 | 0.61 | 0.05 | 0.05 | 0.53 | 2.33 | 2.44 | 2.06 | 2.51 | 1.77 | 2.71 |
| 1035 | ZM55.28a-chim_d7324.201C-433C[1] | 2.68 | 1.06 | 0.62 | 0.05 | 0.08 | 2.69 | 2.19 | 2.35 | 1.6 | 2.5 | 1.68 | 2.6 |
| 1055 | ZM55.28a-chim+int_d7324.201C-433C[2] | 2.59 | 0.39 | 0.54 | 0.07 | 0.06 | 1.36 | 2.15 | 2.82 | 1.69 | 2.16 | 1.59 | 2.59 |
| 1083 | DU422.01-chim-sc_d7324.201C-433C[3] | 2.96 | 2.43 | 0.78 | 0.05 | 0.06 | 0.12 | 1.92 | 2.84 | 2.76 | 0.1 | 1.96 | 2.23 |
| 2117 | bg505.sosip_c15ln.201C-433C[4] | 2.68 | 2.78 | 0.71 | 0.05 | 0.06 | 0.49 | 2.3 | 2.85 | 2.65 | 2.91 | 1.78 | 2.23 |
| 1041 | DU422.01-chim+int_d7324.201C-433C[2] | 2.17 | 1.42 | 0.36 | 0.1 | 0.06 | 2.44 | 1.72 | 2.44 | 1.94 | 0.15 | 1.17 | 2.17 |
| 1061 | DU422.01.sosip_d7324.201C-433C[4] | 2.44 | 1.83 | 0.69 | 0.05 | 0.05 | 0.29 | 1.96 | 2.77 | 2.81 | 0.09 | 1.44 | 2.09 |
| 1034 | ZM53.12-chim_d7324.201C-433C[1] | 2.23 | 0.89 | 0.69 | 0.05 | 0.1 | 1.45 | 0.37 | 1.29 | 1.68 | 2.27 | 1.23 | 1.86 |
| 1097 | ZM106.9-chim-sc_d7324.201C-433C[3] | 1.84 | 2.02 | 0.45 | 0.06 | 0.1 | 0.12 | 1.51 | 3.03 | 2.65 | 2.8 | 1.02 | 1.84 |
| 924 | BI369.9A-chim_d7324.201C-433C[1] | 1.93 | 0.7 | 0.64 | 0.04 | 0.06 | 2.22 | 0.8 | 2.61 | 2.73 | 2.48 | 0.93 | 1.79 |
| 937 | CAP45.G3-chim_d7324.201C-433C[1] | 1.78 | 0.43 | 0.06 | 0.05 | 0.06 | 2.43 | 1.08 | 0.24 | 2.83 | 1.67 | 0.78 | 1.78 |
| 1076 | ZM55.28a.sosip_d7324.201C-433C[4] | 1.65 | 0.73 | 0.54 | 0.05 | 0.05 | 0.41 | 1.95 | 2.47 | 2.28 | 2.07 | 0.65 | 1.65 |
| 964 | DU422.01-chim_d7324.201C-433C[1] | 2.93 | 1.4 | 0.93 | 0.05 | 0.08 | 2.59 | 2.24 | 2.71 | 2.72 | 0.12 | 1.79 | 1.59 |
| 1082 | DU156.12-chim-sc_d7324.201C-433C[3] | 1.57 | 1.72 | 0.23 | 0.07 | 0.07 | 0.13 | 0.23 | 2.9 | 2.78 | 2.56 | 0.72 | 1.57 |
| 990 | QH209.14M.A2-chim_d7324.201C-433C[1] | 0.09 | 2.81 | 0.36 | 0.05 | 0.13 | 2.46 | 2.27 | 0.69 | 2.88 | 2.78 | 1.81 | 1.51 |
| 881 | 25925-2.22-chim_d7324.201C-433C[1] | 2.08 | 0.94 | 0.76 | 0.05 | 0.06 | 2.24 | 0.72 | 2.69 | 2.56 | 2.45 | 1.08 | 1.45 |
| 930 | C1080.c3-chim_d7324.201C-433C[1] | 1.45 | 0.6 | 0.04 | 0.05 | 0.07 | 2.64 | 2.58 | 0.13 | 0.48 | 2.29 | 0.45 | 1.45 |
| 856 | 286.36-chim_d7324.201C-433C[1] | 1.44 | 0.66 | 0.41 | 0.09 | 0.07 | 0.27 | 0.66 | 2.75 | 2.68 | 2.52 | 0.44 | 1.44 |
| 917 | AC10.29-chim_d7324.201C-433C[1] | 0.1 | 2.98 | 0.66 | 0.05 | 0.07 | 2.88 | 2.4 | 3.01 | 2.97 | 2.66 | 1.98 | 1.42 |
| 978 | MW965.26-chim_d7324.201C-433C[1] | 1.38 | 1.02 | 0.14 | 0.05 | 0.05 | 0.97 | 0.2 | 2.35 | 2.68 | 2.76 | 0.38 | 1.38 |
| 1054 | ZM106.9-chim+int_d7324.201C-433C[2] | 3.03 | 2.88 | 1.01 | 0.06 | 0.06 | 2.13 | 2.62 | 3.15 | 2.43 | 2.95 | 1.58 | 1.38 |
| 953 | CNE55-chim_d7324.201C-433C[1] | 1.33 | 2.25 | 0.06 | 0.06 | 0.07 | 0.87 | 2.67 | 0.12 | 2.69 | 2.72 | 1.25 | 1.33 |
| 933 | C4118.09-chim_d7324.201C-433C[1] | 1.18 | 0.85 | 0.07 | 0.14 | 0.3 | 1.69 | 0.68 | 0.2 | 2.77 | 2.71 | 0.18 | 1.18 |
| 962 | DU156.12-chim_d7324.201C-433C[1] | 1.17 | 0.68 | 0.18 | 0.05 | 0.08 | 2.02 | 0.22 | 2.76 | 2.8 | 2.57 | 0.17 | 1.17 |
| 1060 | DU156.12.sosip_d7324.201C-433C[4] | 1.11 | 1.06 | 0.1 | 0.05 | 0.06 | 0.29 | 1.09 | 2.97 | 2.85 | 2.59 | 0.11 | 1.11 |
| 1010 | TH966.8-chim_d7324.201C-433C[1] | 1.07 | 2.02 | 0.04 | 0.05 | 0.06 | 2.48 | 1.85 | 0.09 | 0.21 | 2.65 | 1.02 | 1.07 |
| 940 | CH117.4-chim_d7324.201C-433C[1] | 2.26 | 0.48 | 0.91 | 0.05 | 0.1 | 2.81 | 1.56 | 0.15 | 2.79 | 3.1 | 1.24 | 1.04 |
| 902 | 620345.c1-chim_d7324.201C-433C[1] | 1.02 | 0.77 | 0.04 | 0.05 | 0.06 | 2.31 | 0.58 | 0.16 | 2.5 | 0.12 | 0.02 | 1.02 |
| 992 | R2184.c4-chim_d7324.201C-433C[1] | 0.99 | 1.83 | 0.07 | 0.06 | 0.06 | 2.62 | 1.09 | 0.12 | 0.25 | 2.82 | 0.83 | 0.99 |
| 1094 | TRO.11-chim-sc_d7324.201C-433C[3] | 0.13 | 2.25 | 0.61 | 0.05 | 0.08 | 0.16 | 0.52 | 2.95 | 3.09 | 2.42 | 1.25 | 0.92 |
| 1029 | ZM197.7-chim_d7324.201C-433C[1] | 2.6 | 0.94 | 1.07 | 0.05 | 0.08 | 2.5 | 0.32 | 0.11 | 2.57 | 2.81 | 1.1 | 0.9 |
| 908 | 6545.V4.C1-chim_d7324.201C-433C[1] | 1.04 | 1.91 | 0.64 | 0.04 | 0.06 | 2.56 | 0.73 | 0.12 | 0.2 | 0.12 | 0.91 | 0.88 |
| 973 | MB201.A1-chim_d7324.201C-433C[1] | 0.08 | 2.17 | 0.12 | 0.05 | 0.08 | 2.91 | 1.72 | 2.55 | 2.77 | 2.7 | 1.17 | 0.87 |
| 871 | 0921.V2.C14-chim_d7324.201C-433C[1] | 1.01 | 0.53 | 0.64 | 0.07 | 0.06 | 0.57 | 0.13 | 0.16 | 2.77 | 2.98 | 0.01 | 0.86 |
| 888 | 3301.V1.C24-chim_d7324.201C-433C[1] | 1.84 | 0.18 | 0.85 | 0.05 | 0.09 | 2.41 | 2.17 | 2.82 | 2.15 | 2.96 | 0.84 | 0.84 |
| 951 | CNE5-chim_d7324.201C-433C[1] | 0.8 | 0.35 | 0.05 | 0.12 | 0.09 | 0.61 | 0.17 | 0.16 | 0.56 | 1.8 | -0.2 | 0.8 |
| 886 | 3016.v5.c45-chim_d7324.201C-433C[1] | 0.78 | 0.68 | 0.27 | 0.06 | 0.19 | 1.6 | 0.25 | 0.16 | 2.77 | 2.99 | -0.2 | 0.78 |
| 961 | DU151.02-chim_d7324.201C-433C[1] | 0.73 | 0.7 | 0.46 | 0.08 | 0.06 | 2.82 | 2.08 | 2.42 | 2.81 | 1.28 | -0.3 | 0.73 |
| 1086 | KER2018.11-chim-sc_d7324.201C-433C[3] | 2.02 | 1.29 | 0.93 | 0.05 | 0.06 | 0.11 | 1.75 | 0.15 | 2.86 | 2.48 | 0.91 | 0.71 |
| 907 | 6545.V3.C13-chim_d7324.201C-433C[1] | 0.69 | 1.43 | 0.37 | 0.05 | 0.06 | 2.47 | 0.67 | 0.12 | 0.21 | 0.1 | 0.43 | 0.69 |
| 921 | BB201.B42-chim_d7324.201C-433C[1] | 0.65 | 0.52 | 0.08 | 0.05 | 0.06 | 2.57 | 1.62 | 2.54 | 2.8 | 2.65 | -0.4 | 0.65 |
| 898 | 3873.V1.C24-chim_d7324.201C-433C[1] | 0.62 | 0.25 | 0.61 | 0.05 | 0.07 | 1.26 | 0.08 | 2.67 | 2.81 | 2.6 | -0.4 | 0.56 |

FIG. 53B

| SEQ ID NO | Name | VRC26 | PGT 145 | F105 | 17b | 17b+ CD4 | PGT 151 | 35O22 | PGT 122 | 447-52D | VRC 01 | ScoreA | ScoreB |
|---|---|---|---|---|---|---|---|---|---|---|---|---|---|
| 956 | CNE58-chim_d7324.201C-433C[1] | 2.83 | 0.9 | 1.17 | 0.05 | 0.05 | 0.39 | 0.97 | 2.5 | 2.6 | 1.54 | 0.74 | 0.54 |
| 863 | 0013095-2.11-chim_d7324.201C-433C[1] | 0.52 | 0.31 | 0.28 | 0.1 | 0.07 | 0.39 | 0.34 | 0.35 | 2.83 | 3.03 | -0.5 | 0.52 |
| 1044 | KER2018.11-chim+int_d7324.201C-433C[2] | 1.73 | 1.29 | 0.91 | 0.07 | 0.08 | 1.63 | 2.27 | 0.19 | 2.62 | 2.46 | 0.68 | 0.48 |
| 1040 | DU156.12-chim+int_d7324.201C-433C[2] | 0.38 | 0.64 | 0.16 | 0.08 | 0.07 | 2.08 | 0.47 | 2.64 | 2.67 | 2.25 | -0.4 | 0.38 |
| 889 | 3326.V4.C3-chim_d7324.201C-433C[1] | 0.33 | 0.19 | 0.23 | 0.05 | 0.05 | 0.74 | 0.11 | 0.12 | 2.67 | 1.12 | -0.7 | 0.33 |
| 868 | 0330.v4.c3-chim_d7324.201C-433C[1] | 0.33 | 0.6 | 0.35 | 0.05 | 0.09 | 3.16 | 1.72 | 2.69 | 2.67 | 2.99 | -0.4 | 0.33 |
| 977 | MS208.A1-chim_d7324.201C-433C[1] | 0.27 | 0.77 | 0.09 | 0.05 | 0.05 | 1.69 | 0.07 | 0.93 | 2.31 | 2.14 | -0.2 | 0.27 |
| 1011 | TH976.17-chim_d7324.201C-433C[1] | 0.27 | 0.23 | 0.04 | 0.05 | 0.06 | 2.79 | 2.08 | 0.1 | 2.58 | 2.66 | -0.7 | 0.27 |
| 896 | 3718.v3.c11-chim_d7324.201C-433C[1] | 0.25 | 0.26 | 0.36 | 0.06 | 0.06 | 1.37 | 0.67 | 0.61 | 2.76 | 2.61 | -0.7 | 0.25 |
| 890 | 3337.V2.C6-chim_d7324.201C-433C[1] | 0.24 | 0.16 | 0.38 | 0.05 | 0.07 | 2.68 | 2.3 | 2.19 | 2.73 | 2.99 | -0.8 | 0.24 |
| 911 | 6785.V5.C14-chim_d7324.201C-433C[1] | 0.24 | 0.22 | 0.33 | 0.06 | 0.06 | 0.26 | 0.13 | 2.09 | 2.66 | 2.38 | -0.8 | 0.24 |
| 996 | RW020.2-chim_d7324.201C-433C[1] | 0.19 | 0.45 | 0.14 | 0.04 | 0.05 | 1.03 | 0.62 | 1.14 | 1.69 | 2.07 | -0.6 | 0.19 |
| 935 | CAP210.E8-chim_d7324.201C-433C[1] | 0.19 | 0.19 | 0.09 | 0.06 | 0.11 | 0.09 | 0.17 | 0.18 | 2.62 | 0.41 | -0.8 | 0.19 |
| 946 | CNE3-chim_d7324.201C-433C[1] | 0.18 | 0.39 | 0.05 | 0.09 | 0.07 | 1.82 | 1.41 | 0.12 | 0.59 | 0.41 | -0.6 | 0.18 |
| 876 | 235-47-chim_d7324.201C-433C[1] | 0.17 | 0.29 | 0.24 | 0.05 | 0.05 | 1.35 | 0.1 | 2.73 | 2.82 | 3.03 | -0.7 | 0.17 |
| 904 | 6405.v4.c34-chim_d7324.201C-433C[1] | 0.16 | 0.19 | 0.07 | 0.06 | 0.05 | 0.1 | 0.42 | 0.79 | 2.3 | 1.43 | -0.8 | 0.16 |
| 1032 | ZM233.6-chim_d7324.201C-433C[1] | 0.15 | 0.3 | 0.18 | 0.06 | 0.05 | 0.15 | 0.14 | 0.11 | 2.62 | 0.2 | -0.7 | 0.15 |
| 1091 | RW020.2-chim-sc_d7324.201C-433C[3] | 0.15 | 0.98 | 0.11 | 0.05 | 0.07 | 0.1 | 0.22 | 1.4 | 1.21 | 2 | -0 | 0.15 |
| 1074 | ZA012.29.sosip_d7324.201C-433C[4] | 0.15 | 0.3 | 0.48 | 0.05 | 0.07 | 0.08 | 0.16 | 1.16 | 1.44 | 2.18 | -0.7 | 0.15 |
| 1064 | KER2018.11.sosip_d7324.201C-433C[4] | 0.15 | 0.33 | 0.48 | 0.07 | 0.06 | 0.11 | 0.28 | 0.17 | 2.73 | 2.16 | -0.7 | 0.15 |
| 1007 | T278-50-chim_d7324.201C-433C[1] | 0.14 | 0.2 | 0.33 | 0.05 | 0.11 | 0.18 | 0.16 | 2.06 | 2.65 | 0.18 | -0.8 | 0.14 |
| 1015 | TV1.29-chim_d7324.201C-433C[1] | 0.14 | 0.2 | 0.34 | 0.05 | 0.05 | 0.16 | 0.1 | 0.92 | 2.72 | 0.2 | -0.8 | 0.14 |
| 939 | CH070.1-chim_d7324.201C-433C[1] | 0.14 | 0.27 | 0.38 | 0.05 | 0.05 | 0.57 | 0.1 | 2.45 | 0.47 | 0.64 | -0.7 | 0.14 |
| 866 | 00836-2.5-chim_d7324.201C-433C[1] | 0.13 | 0.45 | 0.25 | 0.05 | 0.05 | 1.1 | 0.27 | 0.22 | 2.62 | 1.81 | -0.6 | 0.13 |
| 991 | R1166.c1-chim_d7324.201C-433C[1] | 0.13 | 0.2 | 0.07 | 0.06 | 0.08 | 1.91 | 0.79 | 0.1 | 0.49 | 2.62 | -0.8 | 0.13 |
| 984 | Q461.e2-chim_d7324.201C-433C[1] | 0.13 | 0.23 | 0.06 | 0.05 | 0.05 | 0.09 | 0.07 | 0.12 | 2.51 | 0.26 | -0.8 | 0.13 |
| 880 | 25711-2.4-chim_d7324.201C-433C[1] | 0.12 | 0.32 | 0.42 | 0.06 | 0.06 | 0.54 | 0.96 | 2.74 | 2.77 | 2.8 | -0.7 | 0.12 |
| 858 | 3988.25-chim_d7324.201C-433C[1] | 0.12 | 0.29 | 0.09 | 0.06 | 0.06 | 0.47 | 1.97 | 2.97 | 2.95 | 1.26 | -0.7 | 0.12 |
| 957 | CNE59-chim_d7324.201C-433C[1] | 0.12 | 0.35 | 0.06 | 0.06 | 0.06 | 0.44 | 1.05 | 0.11 | 2.68 | 2.57 | -0.6 | 0.12 |
| 1071 | TRJO.58.sosip_d7324.201C-433C[4] | 0.12 | 0.27 | 0.5 | 0.05 | 0.05 | 0.12 | 0.51 | 0.5 | 2.97 | 2.12 | -0.7 | 0.12 |
| 1072 | TRO.11.sosip_d7324.201C-433C[4] | 0.12 | 0.33 | 0.24 | 0.06 | 0.07 | 0.17 | 0.11 | 2.84 | 2.98 | 2.06 | -0.7 | 0.12 |
| 885 | 271-11-chim_d7324.201C-433C[1] | 0.11 | 0.26 | 0.04 | 0.05 | 0.05 | 0.11 | 0.1 | 0.12 | 1.91 | 2.55 | -0.7 | 0.11 |
| 972 | M02138-chim_d7324.201C-433C[1] | 0.11 | 0.18 | 0.04 | 0.05 | 0.05 | 2.07 | 1.75 | 0.09 | 2.84 | 2.36 | -0.8 | 0.11 |
| 1026 | ZM109.4-chim_d7324.201C-433C[1] | 0.11 | 0.93 | 0.41 | 0.05 | 0.12 | 1.96 | 2.31 | 1.63 | 2.52 | 3.01 | -0.1 | 0.11 |
| 987 | Q842.d12-chim_d7324.201C-433C[1] | 0.11 | 0.49 | 0.17 | 0.05 | 0.07 | 1.37 | 0.79 | 0.88 | 2.55 | 1.97 | -0.5 | 0.11 |
| 905 | 6471.V1.C16-chim_d7324.201C-433C[1] | 0.1 | 0.21 | 0.41 | 0.05 | 0.11 | 1.44 | 0.41 | 0.94 | 2.36 | 0.13 | -0.8 | 0.1 |
| 926 | BR025.9-chim_d7324.201C-433C[1] | 0.1 | 0.25 | 0.04 | 0.05 | 0.14 | 0.58 | 0.09 | 1.77 | 2.52 | 1.28 | -0.7 | 0.1 |
| 909 | 6631.V3.C10-chim_d7324.201C-433C[1] | 0.1 | 0.19 | 0.27 | 0.05 | 0.06 | 2.2 | 1.8 | 2.15 | 2.67 | 0.28 | -0.8 | 0.1 |
| 954 | CNE56-chim_d7324.201C-433C[1] | 0.1 | 0.56 | 0.23 | 0.06 | 0.06 | 1.35 | 1.9 | 0.26 | 2.9 | 2.82 | -0.4 | 0.1 |
| 1069 | RW020.2.sosip_d7324.201C-433C[4] | 0.1 | 0.34 | 0.17 | 0.05 | 0.05 | 0.09 | 1.31 | 1.3 | 1.93 | 2.19 | -0.7 | 0.1 |
| 969 | KER2008.12-chim_d7324.201C-433C[1] | 0.1 | 0.27 | 0.04 | 0.05 | 0.05 | 0.1 | 0.09 | 0.25 | 0.2 | 0.21 | -0.7 | 0.1 |
| 1009 | T33-7-chim_d7324.201C-433C[1] | 0.1 | 0.35 | 0.06 | 0.05 | 0.05 | 1.35 | 0.22 | 0.1 | 1.64 | 2.63 | -0.7 | 0.1 |
| 925 | BL01.DG-chim_d7324.201C-433C[1] | 0.09 | 0.17 | 0.54 | 0.05 | 0.21 | 0.43 | 0.32 | 2.33 | 2.85 | 0.11 | -0.8 | 0.09 |
| 1002 | T251-18-chim_d7324.201C-433C[1] | 0.09 | 0.23 | 0.55 | 0.05 | 0.11 | 0.16 | 0.2 | 2.08 | 2.46 | 0.62 | -0.8 | 0.09 |
| 894 | 3589.V1.C4-chim_d7324.201C-433C[1] | 0.09 | 0.21 | 0.47 | 0.05 | 0.05 | 0.98 | 0.19 | 0.1 | 2.53 | 2.63 | -0.8 | 0.09 |
| 965 | HO86.8-chim_d7324.201C-433C[1] | 0.09 | 1.04 | 0.06 | 0.06 | 0.23 | 1.99 | 1.12 | 0.21 | 2.92 | 0.2 | 0.04 | 0.09 |
| 884 | 269-12-chim_d7324.201C-433C[1] | 0.08 | 0.21 | 0.09 | 0.04 | 0.05 | 0.12 | 0.53 | 0.96 | 2.49 | 0.53 | -0.8 | 0.08 |
| 993 | R3265.c6-chim_d7324.201C-433C[1] | 0.08 | 1.23 | 0.04 | 0.05 | 0.09 | 2.74 | 0.24 | 0.09 | 0.24 | 2.48 | 0.23 | 0.08 |
| 1022 | X2088.c9-chim_d7324.201C-433C[1] | 0.08 | 0.21 | 0.38 | 0.05 | 0.06 | 0.24 | 0.38 | 1.98 | 2.82 | 0.17 | -0.8 | 0.08 |
| 1018 | UG021.16-chim_d7324.201C-433C[1] | 0.08 | 0.21 | 0.1 | 0.05 | 0.06 | 0.09 | 0.07 | 2.04 | 0.21 | 0.36 | -0.8 | 0.08 |
| 893 | 3468.V1.C12-chim_d7324.201C-433C[1] | 0.17 | 0.19 | 0.64 | 0.05 | 0.07 | 2.71 | 2.39 | 1.42 | 2.77 | 3 | -0.8 | 0.02 |

FIG. 53C

| SEQ ID NO | Name | VRC26 | PGT 145 | F105 | 17b | 17b+ CD4 | PGT 151 | 35O22 | PGT 122 | 447-52D | VRC 01 | ScoreA | ScoreB |
|---|---|---|---|---|---|---|---|---|---|---|---|---|---|
| 1014 | TRO.11-chim_d7324.201C-433C[1] | 0.08 | 0.63 | 0.65 | 0.05 | 0.08 | 1.29 | 0.68 | 2.69 | 2.89 | 2.44 | -0.4 | -0.1 |
| 1066 | Q168.a2.sosip_d7324.201C-433C[4] | 0.19 | 0.32 | 0.68 | 0.05 | 0.05 | 0.49 | 2.1 | 0.32 | 2.7 | 2.69 | -0.7 | -0.1 |
| 1093 | TRJO.58-chim-sc_d7324.201C-433C[3] | 0.13 | 0.64 | 0.68 | 0.05 | 0.07 | 0.08 | 0.13 | 0.41 | 3.02 | 2.39 | -0.4 | -0.2 |
| 922 | BB539.2B13-chim_d7324.201C-433C[1] | 0.44 | 0.31 | 0.76 | 0.05 | 0.06 | 1.81 | 0.88 | 0.11 | 2.62 | 1.82 | -0.6 | -0.2 |
| 958 | CNE7-chim_d7324.201C-433C[1] | 1.83 | 0.81 | 1.14 | 0.06 | 0.06 | 1.49 | 2.36 | 2.22 | 2.72 | 2.47 | -0.1 | -0.3 |
| 981 | Q168.a2-chim_d7324.201C-433C[1] | 0.19 | 0.39 | 0.73 | 0.05 | 0.07 | 2.28 | 2.22 | 0.68 | 2.61 | 2.85 | -0.6 | -0.3 |
| 1001 | T250-4-chim_d7324.201C-433C[1] | 2.54 | 2.23 | 1.33 | 0.05 | 0.07 | 2.93 | 1.45 | 2.12 | 2.45 | 0.13 | -0.2 | -0.4 |
| 928 | BS208.B1-chim_d7324.201C-433C[1] | 0.78 | 0.77 | 0.9 | 0.08 | 0.1 | 1.67 | 0.08 | 2.04 | 2.7 | 2.99 | -0.2 | -0.4 |
| 882 | 26191-2.48-chim_d7324.201C-433C[1] | 2.53 | 0.48 | 1.34 | 0.05 | 0.06 | 2.59 | 0.22 | 2.39 | 2.58 | 3.01 | -0.2 | -0.4 |
| 941 | CH181.12-chim_d7324.201C-433C[1] | 2.93 | 2.03 | 1.45 | 0.06 | 0.13 | 2.65 | 2.51 | 2.85 | 2.84 | 2.49 | -0.2 | -0.4 |
| 1053 | ZA012.29-chim+int_d7324.201C-433C[2] | 0.16 | 0.45 | 0.76 | 0.05 | 0.06 | 0.54 | 0.85 | 2.1 | 1.23 | 2.17 | -0.6 | -0.5 |
| 910 | 6644.V2.C33-chim_d7324.201C-433C[1] | 0.09 | 0.16 | 0.79 | 0.05 | 0.05 | 0.23 | 0.08 | 1.67 | 2.65 | 2.2 | -0.8 | -0.7 |
| 1013 | TRJO.58-chim_d7324.201C-433C[1] | 0.09 | 0.2 | 0.8 | 0.06 | 0.06 | 0.47 | 0.41 | 0.58 | 2.86 | 2.53 | -0.8 | -0.7 |
| 862 | 7165.18-chim_d7324.201C-433C[1] | 0.16 | 1.51 | 0.85 | 0.06 | 0.08 | 1 | 0.4 | 3.07 | 3.02 | 0.45 | 0.51 | -0.8 |
| 945 | CNE15-chim_d7324.201C-433C[1] | 0.27 | 0.32 | 0.87 | 0.07 | 0.08 | 1.71 | 0.47 | 0.71 | 1.81 | 2.99 | -0.7 | -0.8 |
| 1005 | T257-31-chim_d7324.201C-433C[1] | 1.85 | 0.6 | 1.27 | 0.05 | 0.07 | 2.34 | 0.19 | 0.12 | 2.59 | 2.5 | -0.6 | -0.8 |
| 1088 | Q168.a2-chim-sc_d7324.201C-433C[3] | 0.26 | 0.75 | 0.89 | 0.05 | 0.05 | 0.13 | 1.16 | 0.6 | 2.81 | 2.93 | -0.2 | -0.9 |
| 994 | REJO.67-chim_d7324.201C-433C[1] | 0.09 | 0.29 | 0.85 | 0.05 | 0.05 | 0.3 | 0.36 | 0.1 | 1.05 | 2.3 | -0.7 | -0.9 |
| 1021 | WITO.33-chim_d7324.201C-433C[1] | 0.1 | 2.27 | 1.07 | 0.05 | 0.06 | 2.03 | 0.3 | 2.6 | 2.83 | 1.94 | 0.57 | -0.9 |
| 1024 | ZA012.29-chim_d7324.201C-433C[1] | 0.12 | 0.47 | 0.87 | 0.06 | 0.1 | 2.06 | 1 | 1.82 | 1.34 | 2.51 | -0.5 | -1 |
| 975 | MI369.A5-chim_d7324.201C-433C[1] | 0.23 | 0.36 | 0.9 | 0.06 | 0.07 | 0.73 | 0.19 | 2.43 | 2.28 | 2.1 | -0.7 | -1 |
| 865 | 0077_V1.C16-chim_d7324.201C-433C[1] | 2.86 | 0.26 | 1.57 | 0.07 | 0.11 | 2.47 | 2.75 | 0.2 | 1.92 | 1.36 | -0.8 | -1 |
| 912 | 6838.V1.C35-chim_d7324.201C-433C[1] | 0.48 | 0.23 | 0.99 | 0.05 | 0.07 | 1.02 | 0.36 | 0.82 | 2.52 | 2.29 | -0.9 | -1.1 |
| 915 | 96ZM651.02-chim_d7324.201C-433C[1] | 0.57 | 0.39 | 1.03 | 0.05 | 0.06 | 2.59 | 0.36 | 2.92 | 2.74 | 2.2 | -0.9 | -1.1 |
| 985 | Q769.d22-chim_d7324.201C-433C[1] | 0.15 | 1.37 | 0.95 | 0.05 | 0.06 | 1.8 | 0.44 | 0.1 | 2.54 | 2.68 | 0.17 | -1.2 |
| 944 | CNE14-chim_d7324.201C-433C[1] | 0.38 | 0.22 | 1.01 | 0.09 | 0.1 | 0.11 | 0.17 | 2.7 | 0.32 | 0.85 | -1.1 | -1.3 |
| 1051 | TRO.11-chim+int_d7324.201C-433C[2] | 0.11 | 0.49 | 0.96 | 0.07 | 0.06 | 0.38 | 1.59 | 3 | 2.95 | 2.14 | -0.8 | -1.3 |
| 859 | 5768.04-chim_d7324.201C-433C[1] | 0.12 | 0.4 | 0.98 | 0.06 | 0.11 | 1.8 | 1.1 | 2.16 | 2.91 | 2.68 | -0.9 | -1.4 |
| 960 | DU123.06-chim_d7324.201C-433C[1] | 0.14 | 0.29 | 0.99 | 0.09 | 0.07 | 2.18 | 0.1 | 2.67 | 2.79 | 1.63 | -1.1 | -1.4 |
| 864 | 001428-2.42-chim_d7324.201C-433C[1] | 0.36 | 0.87 | 1.05 | 0.07 | 0.21 | 1 | 0.18 | 2.24 | 2.77 | 2.83 | -0.7 | -1.4 |
| 1027 | ZM135.10a-chim_d7324.201C-433C[1] | 0.09 | 0.25 | 0.98 | 0.05 | 0.05 | 0.22 | 0.08 | 2.17 | 2.67 | 2.17 | -1.1 | -1.4 |
| 891 | 3365.v2.c20-chim_d7324.201C-433C[1] | 0.1 | 0.19 | 1.01 | 0.05 | 0.49 | 0.42 | 1.91 | 0.25 | 2.81 | 3.08 | -1.2 | -1.5 |
| 869 | 0439.v5.c1-chim_d7324.201C-433C[1] | 0.27 | 1.35 | 1.07 | 0.06 | 0.06 | 1.86 | 2.42 | 0.1 | 2.78 | 3.02 | -0.3 | -1.6 |
| 1030 | ZM214.15-chim_d7324.201C-433C[1] | 0.18 | 0.22 | 1.08 | 0.05 | 0.07 | 1.8 | 1.37 | 1.83 | 2.42 | 2.54 | -1.5 | -1.7 |
| 1096 | ZA012.29-chim-sc_d7324.201C-433C[3] | 0.18 | 0.72 | 1.11 | 0.05 | 0.1 | 0.11 | 0.83 | 2.15 | 2.18 | 2.72 | -1.1 | -1.9 |
| 895 | 3637.V5.C3-chim_d7324.201C-433C[1] | 0.13 | 0.19 | 1.1 | 0.05 | 0.06 | 0.96 | 0.33 | 0.15 | 2.64 | 1.69 | -1.6 | -1.9 |
| 1068 | Q769.h5.sosip_d7324.201C-433C[4] | 0.09 | 0.61 | 1.09 | 0.05 | 0.06 | 0.09 | 1.23 | 0.13 | 2.71 | 2.7 | -1.1 | -1.9 |
| 879 | 25710-2.43-chim_d7324.201C-433C[1] | 1.43 | 1.08 | 1.45 | 0.09 | 0.11 | 0.87 | 0.14 | 2.9 | 2.84 | 2.67 | -1.8 | -2 |
| 1003 | T253-11-chim_d7324.201C-433C[1] | 0.08 | 0.22 | 1.12 | 0.05 | 0.06 | 1.04 | 0.37 | 0.23 | 2.68 | 2.39 | -1.7 | -2 |
| 914 | 928-28-chim_d7324.201C-433C[1] | 0.18 | 0.23 | 1.17 | 0.05 | 0.05 | 0.99 | 0.46 | 2.2 | 2.71 | 2.65 | -1.9 | -2.1 |
| 903 | 6322.V4.C1-chim_d7324.201C-433C[1] | 2.33 | 0.67 | 1.72 | 0.07 | 0.1 | 1.4 | 0.21 | 0.22 | 2.7 | 0.31 | -1.9 | -2.1 |
| 873 | 16845-2.22-chim_d7324.201C-433C[1] | 0.09 | 0.18 | 1.16 | 0.05 | 0.08 | 0.99 | 0.07 | 2.73 | 2.73 | 1.73 | -1.9 | -2.2 |
| 883 | 263-8-chim_d7324.201C-433C[1] | 0.98 | 0.24 | 1.39 | 0.05 | 0.06 | 1.08 | 0.25 | 2.35 | 2.72 | 2.91 | -2 | -2.2 |
| 1050 | TRJO.58-chim+int_d7324.201C-433C[2] | 0.15 | 0.29 | 1.19 | 0.08 | 0.06 | 0.29 | 0.56 | 0.64 | 2.94 | 2.45 | -1.9 | -2.2 |
| 959 | DJ263.8-chim_d7324.201C-433C[1] | 0.16 | 0.21 | 1.21 | 0.08 | 0.12 | 0.16 | 0.25 | 1.35 | 2.74 | 2.47 | -2 | -2.3 |
| 952 | CNE53-chim_d7324.201C-433C[1] | 0.13 | 0.96 | 1.2 | 0.08 | 0.06 | 0.9 | 0.21 | 2.46 | 2.58 | 2.63 | -1.2 | -2.3 |
| 963 | DU172.17-chim_d7324.201C-433C[1] | 0.09 | 0.28 | 1.19 | 0.05 | 0.08 | 2.08 | 2.22 | 2.64 | 2.48 | 0.32 | -1.9 | -2.3 |
| 929 | BX08.16-chim_d7324.201C-433C[1] | 0.1 | 0.17 | 1.2 | 0.05 | 0.05 | 0.13 | 0.15 | 2.33 | 2.92 | 1.99 | -2 | -2.3 |
| 1047 | Q23.17-chim+int_d7324.201C-433C[2] | 0.38 | 2.45 | 1.47 | 0.07 | 0.09 | 2.76 | 2.62 | 2.77 | 2.65 | 2.61 | -0.8 | -2.3 |
| 1028 | ZM176.66-chim_d7324.201C-433C[1] | 2.26 | 0.34 | 1.76 | 0.05 | 0.08 | 2.84 | 1.35 | 0.56 | 2.64 | 3.02 | -2.2 | -2.4 |
| 874 | 16936-2.21-chim_d7324.201C-433C[1] | 1.33 | 1.82 | 1.54 | 0.05 | 0.06 | 2.18 | 1.89 | 2.95 | 2.82 | 3.03 | -1.8 | -2.4 |

FIG. 53D

| SEQ ID NO | Name | VRC26 | PGT 145 | F105 | 17b | 17b+ CD4 | PGT 151 | 35O22 | PGT 122 | 447-52D | VRC 01 | ScoreA | ScoreB |
|---|---|---|---|---|---|---|---|---|---|---|---|---|---|
| 971 | KNH1209.18-chim_d7324.201C-433C[1] | 0.67 | 1.77 | 1.38 | 0.06 | 0.07 | 2.97 | 2.61 | 2.78 | 2.84 | 2.69 | -1.1 | -2.4 |
| 950 | CNE40-chim_d7324.201C-433C[1] | 0.27 | 1.51 | 1.29 | 0.08 | 0.07 | 1.58 | 0.98 | 1.08 | 2.77 | 2.8 | -1.1 | -2.5 |
| 995 | RHPA.7-chim_d7324.201C-433C[1] | 0.08 | 0.48 | 1.25 | 0.05 | 0.09 | 0.71 | 1.36 | 2.37 | 2.88 | 2.85 | -1.9 | -2.5 |
| 955 | CNE57-chim_d7324.201C-433C[1] | 0.11 | 0.23 | 1.26 | 0.06 | 0.06 | 0.13 | 0.12 | 2.52 | 3.03 | 2.23 | -2.2 | -2.5 |
| 867 | 0260.v5.c36-chim_d7324.201C-433C[1] | 0.14 | 0.22 | 1.3 | 0.05 | 0.06 | 2.31 | 2.28 | 2.97 | 2.77 | 3.04 | -2.4 | -2.6 |
| 1089 | Q23.17-chim-sc_d7324.201C-433C[3] | 0.39 | 2.41 | 1.57 | 0.06 | 0.07 | 0.28 | 1.18 | 2.97 | 2.85 | 2.94 | -1.3 | -2.8 |
| 1090 | Q769.h5-chim-sc_d7324.201C-433C[3] | 0.21 | 0.56 | 1.35 | 0.07 | 0.09 | 0.12 | 0.35 | 0.16 | 2.61 | 2.75 | -2.2 | -2.8 |
| 936 | CAP244.D3-chim_d7324.201C-433C[1] | 0.38 | 0.27 | 1.39 | 0.07 | 0.08 | 0.37 | 0.22 | 0.18 | 2.67 | 2.38 | -2.6 | -2.8 |
| 870 | 0815.V3.C3-chim_d7324.201C-433C[1] | 0.1 | 0.21 | 1.35 | 0.05 | 0.09 | 2.21 | 1.33 | 3.01 | 1.06 | 3.01 | -2.6 | -2.9 |
| 1016 | TZA125.17-chim_d7324.201C-433C[1] | 1.36 | 1.61 | 1.69 | 0.06 | 0.06 | 2.93 | 2.61 | 1.76 | 2.41 | 0.7 | -2.5 | -3 |
| 920 | BaL.26-chim_d7324.201C-433C[1] | 0.15 | 0.19 | 1.41 | 0.06 | 0.06 | 0.13 | 1.45 | 1.71 | 2.86 | 2.18 | -2.9 | -3.1 |
| 1048 | Q769.h5-chim+int_d7324.201C-433C[2] | 0.2 | 0.61 | 1.43 | 0.08 | 0.08 | 1.24 | 1.91 | 0.15 | 2.7 | 2.9 | -2.5 | -3.1 |
| 986 | Q769.h5-chim_d7324.201C-433C[1] | 0.09 | 0.94 | 1.41 | 0.05 | 0.06 | 1.67 | 0.66 | 0.11 | 2.71 | 2.83 | -2.1 | -3.1 |
| 1031 | ZM215.8-chim_d7324.201C-433C[1] | 0.14 | 0.2 | 1.42 | 0.05 | 0.07 | 2.8 | 2.28 | 2.65 | 2.34 | 2.94 | -2.9 | -3.1 |
| 974 | MB539.2B7-chim_d7324.201C-433C[1] | 0.09 | 0.24 | 1.42 | 0.05 | 0.05 | 0.72 | 0.66 | 0.16 | 2.77 | 2.31 | -2.8 | -3.2 |
| 1017 | TZBD.02-chim_d7324.201C-433C[1] | 2.23 | 0.89 | 1.97 | 0.05 | 0.16 | 2.37 | 0.38 | 2.59 | 2.68 | 2.98 | -3 | -3.2 |
| 983 | Q259.17-chim_d7324.201C-433C[1] | 0.22 | 0.24 | 1.49 | 0.05 | 0.06 | 2.28 | 1.13 | 0.11 | 2.65 | 1.7 | -3.1 | -3.3 |
| 901 | 6095.V1.C10-chim_d7324.201C-433C[1] | 0.91 | 0.6 | 1.67 | 0.06 | 0.06 | 2.66 | 1.06 | 0.28 | 2.97 | 2.95 | -3.2 | -3.4 |
| 892 | 3415.v1.c1-chim_d7324.201C-433C[1] | 0.08 | 0.17 | 1.46 | 0.05 | 0.05 | 1.1 | 2.03 | 0.1 | 2.84 | 3.12 | -3.1 | -3.4 |
| 1065 | PVO.04.sosip_d7324.201C-433C[4] | 0.18 | 0.29 | 1.51 | 0.07 | 0.08 | 0.15 | 0.44 | 2.67 | 2.85 | 2.04 | -3.1 | -3.4 |
| 997 | SC422.8-chim_d7324.201C-433C[3] | 0.11 | 3.03 | 1.91 | 0.05 | 0.09 | 3.02 | 1.14 | 2.74 | 2.85 | 2.93 | -2 | -3.5 |
| 947 | CNE30-chim_d7324.201C-433C[1] | 0.16 | 0.25 | 1.54 | 0.06 | 0.08 | 1.81 | 1.33 | 3 | 2.85 | 2.66 | -3.3 | -3.6 |
| 875 | 231965.c1-chim_d7324.201C-433C[1] | 0.08 | 0.18 | 1.57 | 0.05 | 0.05 | 0.42 | 1.05 | 0.12 | 2.74 | 2.95 | -3.5 | -3.8 |
| 1070 | THRO.18.sosip_d7324.201C-433C[4] | 0.1 | 0.27 | 1.57 | 0.06 | 0.06 | 0.08 | 0.09 | 0.15 | 0.25 | 2.19 | -3.4 | -3.8 |
| 1006 | T266-60-chim_d7324.201C-433C[1] | 0.09 | 0.21 | 1.58 | 0.05 | 0.05 | 0.27 | 0.19 | 2.4 | 2.7 | 2.55 | -3.5 | -3.8 |
| 897 | 3817.v2.c59-chim_d7324.201C-433C[1] | 0.1 | 0.18 | 1.59 | 0.05 | 0.09 | 0.33 | 0.68 | 2.08 | 2.69 | 1.97 | -3.6 | -3.9 |
| 857 | 288.38-chim_d7324.201C-433C[1] | 0.13 | 0.2 | 1.61 | 0.07 | 0.08 | 0.13 | 0.3 | 2.75 | 2.86 | 2.34 | -3.6 | -3.9 |
| 999 | SO18.18-chim_d7324.201C-433C[1] | 0.43 | 0.22 | 1.72 | 0.05 | 0.07 | 1.15 | 0.16 | 2.59 | 2.68 | 2.73 | -3.8 | -4 |
| 1059 | CAAN.A2.sosip_d7324.201C-433C[4] | 0.13 | 0.18 | 1.65 | 0.06 | 0.05 | 0.13 | 0.62 | 2.86 | 2.74 | 2.13 | -3.8 | -4.1 |
| 1085 | JRFL.JB-chim-sc_d7324.201C-433C[3] | 0.16 | 0.94 | 1.68 | 0.05 | 0.06 | 0.12 | 0.87 | 2.52 | 2.92 | 2.76 | -3.2 | -4.2 |
| 1008 | T280-5-chim_d7324.201C-433C[1] | 0.11 | 0.26 | 1.67 | 0.05 | 0.1 | 0.22 | 1.66 | 2.61 | 2.78 | 2.75 | -3.8 | -4.2 |
| 1067 | Q23.17.sosip_d7324.201C-433C[4] | 0.13 | 0.55 | 1.7 | 0.05 | 0.05 | 0.16 | 1.91 | 2.83 | 2.71 | 2.72 | -3.6 | -4.3 |
| 918 | ADA.DG-chim_d7324.201C-433C[1] | 0.09 | 0.96 | 1.69 | 0.06 | 0.13 | 2.34 | 0.39 | 2.79 | 2.94 | 2.91 | -3.2 | -4.3 |
| 887 | 3168.V4.C10-chim_d7324.201C-433C[1] | 0.16 | 1.45 | 1.72 | 0.06 | 0.06 | 1.55 | 0.61 | 2.91 | 2.85 | 2.9 | -2.8 | -4.3 |
| 1020 | UG037.8-chim_d7324.201C-433C[1] | 0.1 | 1.22 | 1.7 | 0.04 | 0.07 | 2.87 | 2.8 | 2.57 | 2.62 | 3.06 | -3 | -4.3 |
| 943 | CNE12-chim_d7324.201C-433C[1] | 0.26 | 0.19 | 1.74 | 0.08 | 0.08 | 0.36 | 0.12 | 2.7 | 0.75 | 1.51 | -4.1 | -4.3 |
| 942 | CNE10-chim_d7324.201C-433C[1] | 0.1 | 0.16 | 1.74 | 0.09 | 0.05 | 1.85 | 0.19 | 2.31 | 2.89 | 2.38 | -4.2 | -4.4 |
| 923 | BG1168.01-chim_d7324.201C-433C[1] | 0.1 | 0.24 | 1.74 | 0.06 | 0.11 | 2.51 | 1.12 | 0.12 | 2.96 | 2.97 | -4.1 | -4.5 |
| 927 | BR07.DG-chim_d7324.201C-433C[1] | 0.16 | 0.19 | 1.76 | 0.06 | 0.06 | 0.26 | 0.16 | 0.2 | 2.94 | 2.13 | -4.2 | -4.5 |
| 1058 | BG1168.01.sosip_d7324.201C-433C[4] | 0.15 | 0.34 | 1.76 | 0.06 | 0.07 | 0.72 | 1.12 | 0.1 | 2.91 | 2.69 | -4.1 | -4.5 |
| 949 | CNE4-chim_d7324.201C-433C[1] | 0.17 | 0.35 | 1.77 | 0.07 | 0.06 | 0.18 | 0.55 | 0.89 | 2.89 | 3.08 | -4.1 | -4.5 |
| 1073 | YU2.DG.sosip_d7324.201C-433C[4] | 0.22 | 0.4 | 1.79 | 0.07 | 0.07 | 0.12 | 0.36 | 2.31 | 2.88 | 2.67 | -4.2 | -4.5 |
| 968 | JRFL.JB-chim_d7324.201C-433C[1] | 0.11 | 0.41 | 1.77 | 0.05 | 0.07 | 1.26 | 1.39 | 2.32 | 2.84 | 2.78 | -4.1 | -4.6 |
| 1081 | CAAN.A2-chim-sc_d7324.201C-433C[3] | 0.11 | 0.75 | 1.78 | 0.06 | 0.05 | 0.1 | 0.52 | 3 | 2.84 | 2.56 | -3.8 | -4.6 |
| 900 | 57128.vrc15-chim_d7324.201C-433C[1] | 0.09 | 0.17 | 1.78 | 0.06 | 0.15 | 0.1 | 0.09 | 2.17 | 2.9 | 0.63 | -4.4 | -4.6 |
| 966 | HT593.1-chim_d7324.201C-433C[1] | 0.12 | 1.68 | 1.86 | 0.05 | 0.07 | 2.59 | 2.27 | 0.39 | 2.8 | 2.62 | -3.2 | -4.7 |
| 913 | 89.6.DG-chim_d7324.201C-433C[1] | 0.09 | 0.14 | 1.79 | 0.07 | 0.09 | 2.08 | 1.65 | 2.82 | 2.88 | 2.88 | -4.4 | -4.7 |
| 1063 | JRFL.JB.sosip_d7324.201C-433C[4] | 0.12 | 0.71 | 1.8 | 0.05 | 0.06 | 0.2 | 1.38 | 2.77 | 2.99 | 2.81 | -3.9 | -4.7 |
| 1019 | UG024.2-chim_d7324.201C-433C[1] | 0.1 | 0.28 | 1.81 | 0.05 | 0.05 | 0.21 | 0.76 | 0.1 | 0.22 | 2.22 | -4.4 | -4.8 |
| 1095 | YU2.DG-chim-sc_d7324.201C-433C[3] | 0.14 | 1.66 | 1.88 | 0.06 | 0.08 | 0.36 | 1.43 | 2.73 | 3 | 2.92 | -3.3 | -4.8 |
| 1049 | THRO.18-chim+int_d7324.201C-433C[2] | 0.18 | 0.27 | 1.84 | 0.11 | 0.09 | 0.15 | 0.5 | 0.18 | 0.27 | 2.58 | -4.5 | -4.8 |

FIG. 53E

| SEQ ID NO | Name | VRC26 | PGT 145 | F105 | 17b | 17b+ CD4 | PGT 151 | 35O22 | PGT 122 | 447-52D | VRC 01 | ScoreA | ScoreB |
|---|---|---|---|---|---|---|---|---|---|---|---|---|---|
| 861 | 6535.3-chim_d7324.201C-433C[1] | 0.14 | 0.19 | 1.84 | 0.08 | 0.09 | 0.51 | 0.23 | 3.08 | 2.99 | 2.68 | -4.6 | -4.8 |
| 1092 | THRO.18-chim-sc_d7324.201C-433C[3] | 0.14 | 1.4 | 1.84 | 0.06 | 0.11 | 0.08 | 0.32 | 0.1 | 0.27 | 2.67 | -3.4 | -4.8 |
| 976 | MN.3-chim_d7324.201C-433C[1] | 0.11 | 0.19 | 1.85 | 0.06 | 0.05 | 1.17 | 1.6 | 0.11 | 2.9 | 2.78 | -4.6 | -4.9 |
| 919 | Bal.01-chim_d7324.201C-433C[1] | 0.14 | 0.18 | 1.86 | 0.07 | 0.08 | 1.83 | 1.26 | 2.73 | 2.94 | 3.07 | -4.7 | -4.9 |
| 1039 | CAAN.A2-chim+int_d7324.201C-433C[2] | 0.14 | 0.35 | 1.86 | 0.07 | 0.06 | 2.1 | 2.04 | 2.72 | 2.63 | 2.66 | -4.5 | -4.9 |
| 1023 | YU2.DG-chim_d7324.201C-433C[1] | 0.13 | 0.73 | 1.87 | 0.06 | 0.07 | 1.96 | 1.78 | 2.47 | 2.82 | 2.88 | -4.1 | -4.9 |
| 1087 | PVO.04-chim-sc_d7324.201C-433C[3] | 0.21 | 0.81 | 1.9 | 0.06 | 0.1 | 0.12 | 0.78 | 2.8 | 2.96 | 2.61 | -4.2 | -5 |
| 1043 | JRFL.JB-chim+int_d7324.201C-433C[2] | 0.13 | 0.59 | 1.88 | 0.06 | 0.08 | 1.31 | 1.75 | 2.49 | 2.93 | 2.96 | -4.3 | -5 |
| 979 | NKU3006.ec1-chim_d7324.201C-433C[1] | 0.08 | 0.19 | 1.87 | 0.05 | 0.07 | 2.78 | 1.26 | 0.09 | 2.38 | 2.79 | -4.7 | -5 |
| 916 | A03349M1.vrc4a-chim_d7324.201C-433C[1] | 0.12 | 0.17 | 1.88 | 0.08 | 0.17 | 1.12 | 1.04 | 2.68 | 2.99 | 2.98 | -4.8 | -5 |
| 980 | PVO.04-chim_d7324.201C-433C[1] | 0.09 | 0.39 | 1.87 | 0.05 | 0.14 | 2.43 | 1.01 | 2.55 | 2.88 | 2.5 | -4.5 | -5 |
| 1012 | THRO.18-chim_d7324.201C-433C[1] | 0.09 | 0.5 | 1.88 | 0.05 | 0.13 | 0.58 | 0.5 | 0.09 | 0.21 | 2.61 | -4.4 | -5 |
| 1052 | YU2.DG-chim+int_d7324.201C-433C[2] | 0.12 | 1.21 | 1.93 | 0.06 | 0.21 | 1.28 | 1.56 | 2.85 | 2.95 | 2.9 | -3.9 | -5.2 |
| 1057 | Bal.01.sosip_d7324.201C-433C[1] | 0.2 | 0.32 | 1.98 | 0.11 | 0.08 | 0.24 | 2.58 | 2.76 | 2.89 | 2.88 | -5 | -5.3 |
| 1045 | PVO.04-chim+int_d7324.201C-433C[1] | 0.14 | 0.8 | 1.97 | 0.08 | 0.2 | 0.9 | 1.65 | 2.51 | 2.87 | 2.8 | -4.5 | -5.3 |
| 1062 | JRCSF.JB.sosip_d7324.201C-433C[1] | 0.09 | 0.8 | 1.98 | 0.06 | 0.08 | 1.56 | 2.64 | 2.72 | 3.01 | 2.88 | -4.5 | -5.4 |
| 1056 | 6101.1.sosip_d7324.201C-433C[1] | 0.15 | 0.24 | 2 | 0.12 | 0.1 | 0.18 | 0.56 | 3.13 | 2.76 | 2.95 | -5.2 | -5.5 |
| 1038 | BG1168.01-chim+int_d7324.201C-433C[1] | 0.09 | 0.23 | 2 | 0.07 | 0.11 | 1.87 | 0.93 | 0.13 | 2.86 | 2.86 | -5.2 | -5.5 |
| 1084 | JRCSF.JB-chim-sc_d7324.201C-433C[1] | 0.13 | 0.43 | 2.01 | 0.06 | 0.08 | 0.15 | 0.68 | 2.41 | 3 | 2.88 | -5 | -5.5 |
| 1000 | SS1196.01-chim_d7324.201C-433C[1] | 0.13 | 0.24 | 2.01 | 0.07 | 0.09 | 0.39 | 0.44 | 2.54 | 2.84 | 2.71 | -5.2 | -5.5 |
| 998 | SF162.LS-chim_d7324.201C-433C[1] | 0.09 | 0.21 | 2.01 | 0.06 | 0.47 | 2.15 | 1.11 | 2.53 | 2.84 | 2.62 | -5.2 | -5.5 |
| 1077 | 6101.1-chim-sc_d7324.201C-433C[1] | 0.13 | 0.26 | 2.03 | 0.06 | 0.12 | 0.16 | 1.43 | 3.09 | 2.78 | 2.96 | -5.3 | -5.6 |
| 1078 | Bal.01-chim-sc_d7324.201C-433C[1] | 0.13 | 0.35 | 2.04 | 0.06 | 0.07 | 0.44 | 2.12 | 2.81 | 2.94 | 3.05 | -5.2 | -5.6 |
| 1042 | JRCSF.JB-chim+int_d7324.201C-433C[1] | 0.13 | 0.19 | 2.05 | 0.07 | 0.09 | 1.43 | 2.19 | 2.1 | 2.95 | 3.03 | -5.4 | -5.7 |
| 989 | QH0692.42-chim_d7324.201C-433C[1] | 0.08 | 0.18 | 2.03 | 0.07 | 0.1 | 2.08 | 1.37 | 2.78 | 2.96 | 2.85 | -5.4 | -5.7 |
| 967 | JRCSF.JB-chim_d7324.201C-433C[1] | 0.13 | 0.16 | 2.05 | 0.08 | 0.11 | 0.85 | 0.73 | 2.29 | 2.93 | 2.95 | -5.4 | -5.7 |
| 1037 | Bal.01-chim+int_d7324.201C-433C[1] | 0.1 | 0.22 | 2.08 | 0.07 | 0.08 | 2.18 | 2.71 | 2.52 | 2.88 | 3.08 | -5.5 | -5.8 |
| 1036 | 6101.1-chim+int_d7324.201C-433C[1] | 0.11 | 0.16 | 2.11 | 0.06 | 0.14 | 2.09 | 2.41 | 2.89 | 2.34 | 3.07 | -5.7 | -5.9 |

FIG. 54A

Anti-BG505 Trimer Endpoint Titer

Anti-BG505 V3 Peptide Endpoint Titer

- BG505 SPOSIP Trimer Neg Sel (R03)
- BG505 SOSIP DS Neg Sel (R04)

FIG. 54B

Anti-BG505 trimer endpoint titer

Anti-BG505 V3 peptide endpoint titer

- BG505 SOSIP polyIC
- BG505 SOSIP C201C443 polyIC
- BG505 SOSIP MatrixM
- BG505 SOSIP CC201C443 MatrixM

Neutralizing activity in guinea pig sera at wk18

- ● WT polyIC
- ■ DS polyIC
- ▲ WT Matrix M
- ▼ DS Matrix M

FIG. 55C

Neutralizing activity in rabbit sera at wk18

- ▲ WT Matrix M
- ▼ DS Matrix M

FIG. 56

| Name | Relative binding MFI (Design/vector) | | | Relative MFI values/ Relative MFI 447-52D values | | Clade |
|---|---|---|---|---|---|---|
| | 447-52D | VRC01 | PGT145 and VRC26.25 | VRC01 binding / 447-52D binding | PGT145 + VRC26.25 binding / 447-52D binding | |
| TN6055a-chim_sc10h-iP-10h-HATM | 1.2 | 4.5 | 6.1 | 3.8 | 5.2 | A |
| 6545.V4.C1-chim_sc10h-iP-10h-HATM | 1.2 | 1.4 | 6.1 | 1.1 | 4.9 | |
| 6210A.c4-chim_sc10h-iP-10h-HATM | 1.2 | 5.4 | 6.1 | 4.4 | 4.9 | A |
| ZM197.7-chim_sc10h-iP-10h-HATM | 1.7 | 2.9 | 8.3 | 1.7 | 4.9 | |
| 246F3-chim_sc10h-iP-10h-HATM | 1.8 | 5.3 | 7.6 | 3.2 | 4.7 | C |
| ZM53.12-chim_sc10h-iP-10h-HATM | 1.6 | 2.3 | 7.0 | 1.4 | 4.4 | |
| T250-4-chim_sc10h-iP-MPER-TM | 1.0 | 4.3 | 4.0 | 4.4 | 4.0 | A |
| CNE55-chim_sc10h-iP-10h-HATM | 2.1 | 3.3 | 7.9 | 1.6 | 3.8 | |
| 6545.V4.C1-chim_sc10h-iP-10h-HATM | 1.1 | 1.3 | 4.0 | 1.2 | 3.6 | |
| DU422.O1-chim_sc10h-iP-10h-HATM | 2.4 | 2.5 | 8.4 | 1.1 | 3.6 | |
| 25925-2.22-chim_sc10h-iP-10h-HATM | 2.2 | 2.7 | 7.3 | 1.3 | 3.4 | |
| CNE58-chim_sc10h-iP-10h-HATM | 1.8 | 1.8 | 5.9 | 1.0 | 3.3 | |
| 1683S-2.3-chim_sc10h-iP-10h-HATM | 2.5 | 4.3 | 8.0 | 1.7 | 3.2 | |
| TN6055a-chim_sc10h-iP-MPER-TM | 1.1 | 3.4 | 2.9 | 3.3 | 2.7 | A |
| ZM55.28a-chim_sc10h-iP-MPER-TM | 1.5 | 2.1 | 4.0 | 1.5 | 2.7 | |
| ZM53.12-chim_sc10h-iP-MPER-TM | 1.5 | 2.3 | 4.1 | 1.5 | 2.7 | |
| BJ369.9A-chim_sc10h-iP-10h-HATM | 2.6 | 3.1 | 6.9 | 1.2 | 2.7 | |
| ZM197.7-chim_sc10h-iP-MPER-TM | 2.1 | 3.2 | 5.4 | 1.5 | 2.6 | |
| 1605S-2.3-chim_sc10h-iP-MPER-TM | 2.4 | 3.8 | 6.1 | 1.6 | 2.5 | |
| ZM55.28a-chim_sc15h-SOS-DS-10h-HATM | 1.6 | 2.8 | 3.9 | 1.7 | 2.4 | |

| SEQ ID NO | Construct Name | VRC26 | PGT145 | F105 | 17b | 17b+CD4 | 35o22 | PGT151 | PGT122 | 447-52D | VRC01 |
|---|---|---|---|---|---|---|---|---|---|---|---|
| 1738 | IRFLgp140.BR.SOSIP.664.E168K, BG505 gp41 chim, I201C, A433C_v1_v3 | 0.1728 | | 0.3444 | 0.0549 | 0.0549 | 0.311 | | | 0.1084 | |
| 1735 | IRFLgp140.BR.SOSIP.664.E168K, BG505 gp41 chim, I201C, A433C_v3 | 0.1736 | | 0.6291 | 0.0649 | 0.0509 | 0.2333 | | | 0.1428 | |
| 1738 | IRFLgp140.BR.SOSIP.664.E168K, BG505 gp41 chim, wt | 0.2537 | | 0.6918 | 0.0633 | 0.3859 | 0.2173 | | | 0.1898 | |
| 1739 | IRFLgp140.BR.SOSIP.664.E168K, BG505 gp41 chim, wt I201C, A433C_191-205_v3 | 0.1602 | | 0.2936 | 0.057 | 0.0608 | 0.2106 | | | 0.0961 | |
| 1760 | IRFLgp140.BR.SOSIP.664.E168K, BG505 gp41 chim, I201C, A433C_191-205_v3 | 0.1819 | | | 0.0763 | 0.1874 | 0.345 | | | 0.3024 | |
| 1741 | IRFLgp140.BR.SOSIP.664.E168K, BG505 gp41 chim, wt I201C, A433C_v3 | 0.1356 | | 0.7299 | 0.0756 | 0.1538 | 0.3302 | | 1.813 | 0.1256 | |
| 1769 | IRFLgp140.BR.SOSIP.664.E168K, BG505 gp41 chim, wt I201C, A433C_v1_191-205_v3 | 0.1668 | | 0.8388 | 0.058 | 0.2439 | 0.291 | 1.3367 | | 0.212 | |
| 1763 | IRFLgp140.BR.SOSIP.664.E168K, BG505 gp41 chim, I201C, A433C_v1_sht_v3 | | | 0.5569 | 0.057 | 0.0524 | 0.3257 | | | 0.1661 | |
| 1744 | IRFLgp140.BR.SOSIP.664.E168K, BG505 gp41 chim, wt I201C, A433C_v1_sht_v3 | 0.9321 | 0.6725 | 0.5627 | 0.0606 | 0.0541 | 0.3191 | 1.9002 | 1.7721 | 0.1397 | |
| 1740 | IRFLgp140.BR.SOSIP.664.E168K, BG505 gp41 chim, I201C, A433C_sht_v3 | 0.8126 | 0.6531 | 0.7625 | 0.0539 | 0.0517 | 0.2026 | 1.081 | 1.0843 | 0.2015 | |
| 1736 | IRFLgp140.BR.SOSIP.664.E168K, BG505 gp41 chim, wt I201C, A433C_sht_v3 | 0.6371 | 0.5196 | 0.9551 | 0.0562 | 0.0537 | 0.2344 | 1.2553 | 0.9964 | 0.2292 | |
| 1762 | IRFLgp140.BR.SOSIP.664.E168K, BG505 gp41 chim, I201C, A433C_v1_v2_v3 | 0.1764 | 0.1732 | 0.8311 | 0.0584 | 0.0615 | 0.1855 | 0.9555 | 0.9954 | 0.2104 | |
| 1732 | IRFLgp140.BR.SOSIP.664.E168K, BG505 gp41 chim, wt I201C, A433C_v1_v2_v3 | 0.1586 | 0.1344 | | 0.0608 | 0.0695 | 0.1376 | 0.3459 | | 0.3791 | |
| 1761 | IRFLgp140.BR.SOSIP.664.E168K, BG505 gp41 chim, wt I201C, A433C_NYC_191-205_v3 | 0.2054 | 0.1314 | 0.9989 | 0.064 | 0.0699 | 0.2026 | 0.7105 | | 0.2557 | |
| 1742 | IRFLgp140.BR.SOSIP.664.E168K, BG505 gp41 chim, wt I201C, A433C_v2_v3 | 0.1626 | 0.0792 | | 0.0564 | 0.0549 | 0.1899 | 0.2529 | 0.361 | 0.1869 | |
| 1737 | IRFLgp140.BR.SOSIP.664.E168K, BG505 gp41 chim, I201C, A433C_v2_v3 | 0.1624 | 0.0756 | 0.7962 | 0.0556 | 0.0562 | 0.1297 | 0.2825 | 0.691 | 0.1778 | |
| | Controls: | | | | | | | | | | |
| | BG505gp120, T332N, D7324 | 0.2076 | 0.152 | 0.1187 | 0.0757 | 0.1276 | 0.1376 | 0.1016 | 0.1972 | 0.0558 | 1.8678 |
| | SOSIP_IZ_I2R1C/A433C | 0.7556 | | 0.0947 | 0.0637 | 0.0548 | 0.0699 | | 0.610 | 0.1299 | 2.1022 |
| | BG505SOSIP-D7324 | 0.8792 | | 0.1225 | 0.1726 | 0.9457 | 1.296 | | | 0.1362 | |

FIG. 60
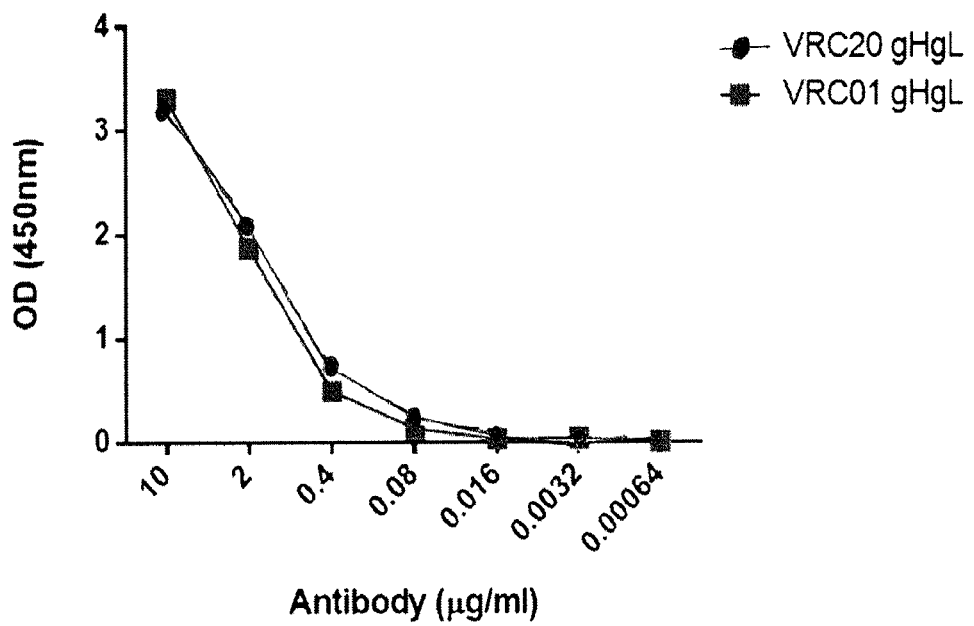
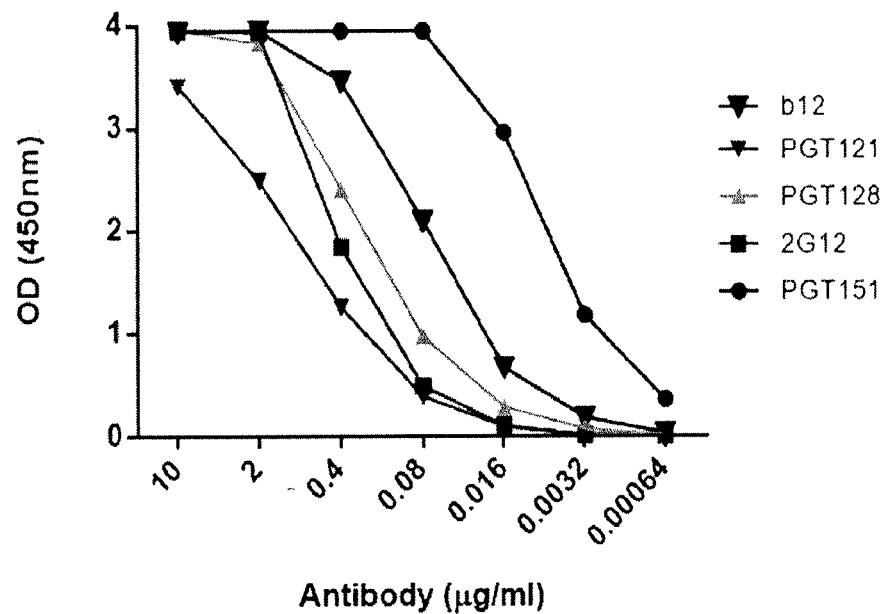

RECOMBINANT HIV-1 ENVELOPE PROTEINS AND THEIR USE

CROSS REFERENCE TO RELATED APPLICATIONS

This is the U.S. National Stage of International Application No. PCT/US2015/048729, filed Sep. 4, 2015, which was published in English under PCT Article 21(2), which in turn claims the benefit of U.S. Provisional Application Nos. 62/046,059, filed Sep. 4, 2014, and 62/136,480, filed Mar. 21, 2015. Each of the provisional applications is incorporated by reference in its entirety.

FIELD

This disclosure relates to recombinant human immunodeficiency virus type 1 (HIV-1) envelope (Env) polypeptides and immunogenic fragments thereof for treatment and prevention of Human Immunodeficiency Virus (HIV) infection and disease.

BACKGROUND

Over the last 50 years, millions of people have been infected or killed by HIV-1. A dominant contributing factor has been the immunoevasion of the HIV-1-Env ectodomain trimer, a type 1 fusion machine that facilitates virus entry into cells by interacting with host cellular receptors and fusing virus and host-cell membranes. Despite its exposed position on the viral membrane and high titers of Env-reactive antibodies in infected individuals, the HIV-1-Env ectodomain trimer successfully evades most antibody-mediated neutralization. This evasion is to a large degree responsible for the difficulty in developing an effective HIV-1 vaccine.

The HIV-1-Env ectodomain trimer includes three gp120-gp41 protomers, and displays unusual posttranslation processing including the addition of 25-30 N-linked glycans per gp120-gp41 protomer, tyrosine sulfation, and slow signal peptide cleavage. As an entry machine, HIV-1 Env undergoes several structural rearrangements from a prefusion mature (cleaved) closed conformation that evades antibody recognition, through intermediate conformations triggered by CD4 and co-receptor (either CCR5 or CXCR4) binding, to a postfusion conformation. Over the last 20 years substantial atomic-level detail has been obtained on these conformations, including structures of CD4-bound gp120, postfusion gp41, and the trimeric arrangement of prefusion gp120. The prefusion mature closed conformation of HIV-1 Env has, however, resisted atomic-level analysis.

It is believed that immunization with an HIV-1 Env ectodomain trimer stabilized in its prefusion mature closed conformation can elicit a neutralizing immune response that is protective against HIV infection. However, the lack of an atomic-level structure of the HIV-1 Env ectodomain trimer in this conformation stymied attempts to design HIV-1 Env proteins that are stabilized in a prefusion mature closed conformation for use as immunogens.

SUMMARY

Disclosed herein for the first time is the atomic-level three dimensional structure of the HIV-1 Env ectodomain (including gp120 and the extracellular portion of gp41) in its prefusion mature closed conformation, the conformation of Env recognized by most broadly neutralizing antibodies. When viewed in the context of previously determined structures of HIV-1 Env in a CD4-bound conformation, the new structure provided herein affords a mechanistic understanding of the conformational transitions that HIV-1 Env undergoes from the mature closed to CD4-bound open prefusion conformations. Analysis of these conformational rearrangements, combined with an understanding of the evasion from and vulnerabilities to the immune system, provided an information matrix that was used to generate recombinant HIV-1 Env ectodomain trimers stabilized in the prefusion mature closed conformation.

The disclosed recombinant HIV-1 Env ectodomain trimers resist transition to the CD4-bound open conformation of HIV-1 Env when incubated with CD4, and thus will retain the prefusion mature closed conformation when used as an immunogen to generate an HIV-1 Env immune response in a subject expressing CD4, such as a human. Retention of the prefusion mature closed conformation in the presence of CD4 avoids exposure of highly antigenic sites on the open conformation of the HIV-1 Env ectodomain that are targeted by poorly neutralizing antibodies (such as 447-52D), and maximizes exposure of antigenic sites on the V1V2 "cap" of the HIV-1 ectodomain that are targeted by broadly neutralizing antibodies.

In several embodiments, an isolated immunogen is provided that comprises a recombinant HIV-1 Env ectodomain trimer or immunogenic fragment thereof stabilized in a prefusion mature closed conformation by one or more amino acid substitutions compared to a native HIV-1 Env sequence. The recombinant HIV-1 Env ectodomain comprises three gp120-gp41 protomers comprising a gp120 polypeptide and a gp41 ectodomain, and remains in the prefusion mature closed conformation when incubated with a molar excess of soluble CD4 (sCD4). In several embodiments, the recombinant HIV-1 Env ectodomain trimer comprises an α7 helix that forms after position 570 of the gp41 ectodomain, and comprises V1V2 domains wherein the distance between positions 200 and 313 of adjacent V1V2 domains in the ectodomain trimer is less than five angstroms. In additional embodiments, the recombinant HIV-1 Env ectodomain trimer or immunogenic fragment specifically binds to VRC26 mAb and/or PGT145 mAb, and does not specifically bind to 17b mAb when incubated with a molar excess of sCD4.

In some embodiments, the recombinant HIV-1 Env ectodomain can be stabilized in the prefusion mature closed conformation by a non-natural disulfide bond between cysteine substitutions at positions 201 and 433. In additional embodiments, the recombinant HIV-1 Env ectodomain can be stabilized in the prefusion mature closed conformation by a non-natural disulfide bond between cysteine substitutions at positions 201 and 433, a non-natural disulfide bond between cysteine substitutions at positions 501 and 605, and a proline substitution at position 559. The HIV-Env positions correspond to a HXB2 reference sequence set forth as SEQ ID NO: 1. The recombinant HIV-1 Env ectodomain can comprises the sequence from a native HIV-1 Env ectodomain, such as from any one of a BG505 (SEQ ID NO: 2), CAP256.SU (SEQ ID NO: 51), a BB201.B42 (SEQ ID NO: 81), a KER2018.11 (SEQ ID NO: 107), a CH070.1 (SEQ ID NO: 174), a ZM233.6 (SEQ ID NO: 745), a Q23.17 (SEQ ID NO: 746), a A244 (SEQ ID NO: 747), a T250-4 (SEQ ID NO: 2114), 426c (SEQ ID NO: 2144), 45_01dG5 (SEQ ID NO: 2145), JRFL (SEQ ID NO: 2115), or a WITO.33 (SEQ ID NO: 748) strain of HIV-1, that has been modified to include the amino acid substitutions that stabilize the recombination HIV-1 Env ectodomain in the prefusion mature closed conformation.

In some embodiments, the recombinant HIV-1 Env ectodomain trimer can be a chimeric HIV-1 Env ectodomain trimer that comprises amino acid sequences from two or more HIV-1 strains. The use of immunogens based on diverse HIV-1 strains can overcome the intrinsic sequence diversity of HIV-1 Env. For example, the recombinant HIV-1 Env ectodomain trimer can comprise a V1V2 domain (such as HIV-1 positions 126-196) from a first strain of HIV-1, with the remainder of the recombinant HIV-1 Env ectodomain trimer from a heterologous strain of HIV-1. In one example, the recombinant HIV-1 Env ectodomain trimer can comprise a V1V2 domain sequence from any one of a CAP256.SU (SEQ ID NO: 51), a BB201.B42 (SEQ ID NO: 81), a KER2018.11 (SEQ ID NO: 107), a CH070.1 (SEQ ID NO: 174), a ZM233.6 (SEQ ID NO: 745), a Q23.17 (SEQ ID NO: 746), a A244 (SEQ ID NO: 747), a T250-4 (SEQ ID NO: 2114), or a WITO.33 (SEQ ID NO: 748) strain of HIV-1, with the remainder of the recombinant HIV-1 Env ectodomain sequence from the BG505 (SEQ ID NO: 2) strain of HIV-1. The chimeric HIV-1 Env ectodomain trimer further includes the one or more amino acid substitutions compared to a native HIV-1 Env sequence for stabilization in the prefusion mature closed conformation. In some embodiments, the chimeric HIV-1 Env ectodomain trimer can comprise a non-natural disulfide bond between cysteine substitutions at positions 201 and 433, a non-natural disulfide bond between cysteine substitutions at positions 501 and 605, and a proline substitution at position 559, to stabilize the HIV-1 Env trimer in the prefusion mature closed conformation.

As described in the Examples, prefusion mature gp41 wraps its hydrophobic core around extended N- and C-mini-strands of gp120. Accordingly, in some embodiments, the recombinant HIV-1 Env ectodomain trimer can include a membrane proximal "platform" including the N- and C-terminal regions of gp120, and the gp41 ectodomain, from a first HIV-1 strain (such as BG505), and the remainder of gp120 from one or more heterologous HIV-1 strains. This chimeric design allows for production of heterogeneous HIV-1 Env proteins that comprise membrane distal features of interest (such as the V1V2 domain, V3 domain, and CD4 binding site) from diverse strains. In some embodiments, the recombinant Env ectodomain can include gp120 residues 31-45 and 478-507, and the gp41 ectodomain (e.g., positions 512-664) from the first HIV-1 strain (such as BG505), and the remainder of the gp120 residues in the Env protein can be from a heterologous HIV-1 strain. In some embodiments, the heterologous HIV-1 strain can be selected from one of a CAP256.SU (SEQ ID NO: 51), a BB201.B42 (SEQ ID NO: 81), a KER2018.11 (SEQ ID NO: 107), a CH070.1 (SEQ ID NO: 174), a ZM233.6 (SEQ ID NO: 745), a Q23.17 (SEQ ID NO: 746), a A244 (SEQ ID NO: 747), a T250-4 (SEQ ID NO: 2114), 426c (SEQ ID NO: 2144), 45_01dG5 (SEQ ID NO: 2145), a JRFL (SEQ ID NO: 2115) or a WITO.33 (SEQ ID NO: 748) strain of HIV-1. The chimeric HIV-1 Env ectodomain trimer further includes the one or more amino acid substitutions compared to a native HIV-1 Env sequence for stabilization in the prefusion mature closed conformation. In some embodiments, the chimeric HIV-1 Env ectodomain trimer can comprise a non-natural disulfide bond between cysteine substitutions at positions 201 and 433, a non-natural disulfide bond between cysteine substitutions at positions 501 and 605, and a proline substitution at position 559, to stabilize the HIV-1 Env trimer in the prefusion mature closed conformation.

In some embodiments, the gp120-gp41 protomers in the recombinant HIV-1 Env ectodomain trimer can be single chain HIV-1 Env ectodomains, wherein the C-terminal residue of the gp120 polypeptide is linked to the N-terminal residues of the gp41 ectodomain (for example, by a peptide linker, such as a 10 amino acid or 15 amino acid glycine-serine peptide linker). In some embodiments, the recombinant HIV-1 Env ectodomain trimer can be linked to a transmembrane domain. For example, the C-terminal residue of gp41 (such as position 664) can be lined to a transmembrane domain by a peptide linker, such as a 10 amino acid glycine-serine peptide linker. The transmembrane domain can be, for example, an influenza HA transmembrane domain.

In additional embodiments, the recombinant HIV-1 Env ectodomain trimer stabilized in the prefusion mature closed conformation can be included on a protein nanoparticle, such as a ferritin or lumazine synthase protein nanoparticle. Nucleic acid molecules encoding the recombinant HIV-1 Env ectodomain trimer stabilized in the prefusion mature closed conformation and vectors including the nucleic acid molecules are also provided. Compositions including the recombinant HIV-1 Env ectodomain trimer or immunogenic fragments thereof, protein nanoparticles, nucleic acid molecules or vectors are also provided. The composition may be a pharmaceutical composition suitable for administration to a subject, and may also be contained in a unit dosage form. The compositions can further include an adjuvant. The recombinant HIV-1 Env ectodomain trimers may also be conjugated to a carrier to facilitate presentation to the immune system.

Methods of generating an immune response in a subject are disclosed, as are methods of treating, inhibiting or preventing a HIV-1 infection in a subject. In such methods a subject, such as a human subject, is administered an effective amount of a disclosed recombinant HIV-1 Env ectodomain trimer or fragment thereof, protein nanoparticle, nucleic acid molecule or viral vector.

The foregoing and other features and advantages of this disclosure will become more apparent from the following detailed description of several embodiments which proceeds with reference to the accompanying figures.

BRIEF DESCRIPTION OF THE FIGURES

FIG. 1A, smFRET of functional viral ectodomains, unliganded or in the presence of antibodies PGT122 and 35O22. Fluorophores were introduced into the V1 and V4 regions of JR-FL gp120, and smFRET signals measured with HIV-1 Env in the membrane-bound virion context (see FIG. 7). The concordance between conformational ensembles indicates unliganded and PGT122+35O22-bound conformation to be similar (Spearman correlation coefficient of 0.988). FIG. 1B, Ternary complex structure of HIV-1-Env trimer BG505 SOSIP.664 with PGT122 Fab and 35O22 Fab. The gp120 subunit is shown in dark grey, the gp41 subunit in lighter grey. One protomer and associated Fabs is shown in ribbon and stick representation, a second protomer in surface representation, and the third protomer in grey.

FIG. 2A, gp41 forms a 4-helix collar which wraps around extended N and C termini of gp120. Both gp120 (darker grey) and gp41 (lighter grey) are depicted in ribbon representation, with select residues and secondary structure labeled. The orientation shown here is similar to that of FIG. 1C, with perpendicular orientations provided in FIGS. 2B and 2C. (insert). The gp41 collar is clasped by the insertion of Met530gp41 into a tryptophan sandwich and by the complementary dipoles of helices α6 and α8. $2F_o$-$F_c$ electron density for clasp residues is depicted at 1s. FIG. 2B, gp41 holds the N and C termini of gp120 in its hydrophobic core. Representation are the same as in a, excepted that hydrophobic side chains are shown in stick representation and the orientation is rotated 90°, to depict the view from the viral membrane. FIG. 2C, gp41-trimer interfaces as viewed from side in ribbon and surface representation.

FIGS. 3A-3D illustrate entry rearrangements of HIV-1 Env. FIG. 3A, BG505 sequence of gp41 subunit (positions 512-664 of SEQ ID NO: 2), with prefusion and postfusion secondary structure. Fusion peptide (FP) is underlined. FIG. 3B, Difference distance analysis of prefusion BG505 and postfusion HIV-1/SIV chimeric gp41. Missing residues of BG505 (548-569) and of SIV (611-614) are indicated, along with secondary structure. FIG. 3C, Superposition of postfusion gp41 onto prefusion gp41 for α7 (left) and α9 (right) prefusion helices. FIG. 3D, HIV-1-Env entry rearrangements. EM reconstructions (top row) with gp120 (middle) and gp41 (bottom) rearrangements between each conformational state highlighted with lines to depict moving Cα between each conformation. Subunit models are shown in gray with modeling parameters provided in FIG. 15. Antigenic recognition of each of these state is shown in FIG. 26.

FIGS. 4A-4C illustrate that the prefusion HIV-1 gp120-gp41 structure shares conserved structural and topological features with other type 1 fusion machines. FIG. 4A, Prefusion (left) and postfusion (right) structures. The prefusion structures are shown for a single protomer in ribbon-representation. FIG. 4B, the preformed C-terminal helix of postfusion coiled coil from a is shown, with fusion peptides (FP) and N and C terminal residues of postfusion coiled coils labeled, and the distance the inner coiled coil extends between prefusion and postfusion conformations indicated. FIG. 4C, The gp41-equivalents encircle extended β-strands of their gp120-equivalent partners. Ribbon representation are shown looking towards the viral membrane.

FIG. 5A, Glycan shield. Env N-linked glycans are depicted in light grey (conserved; greater than 90% conservation) or dark grey (variable; less than 90% conservation) on the mature near-native Env structures for BG505 strain of HIV-1 (left), influenza virus H3 hemagglutinin (PDB: 2YP7) (middle), and RSV fusion glycoprotein subtype A (PDB: 4JHW) (right). Two conserved glycans, at residues 241gp120 and 616gp41 are not in the BG505 sequence. FIG. 5B, Env sequence variability. FIG. 5C, HIV-1-Env N-linked glycans and sequence variability for near-native and CD4-bound conformations.

FIGS. 6A-6E illustrate the location and prevalence on the HIV-1-Env ectodomain trimer of neutralizing responses identified serologically from cohorts from 2-3 and 5+ years post-infection. FIG. 6A, The location of the neutralization epitopes for the different antibody specificities on the prefusion mature closed Env ectodomain trimer is depicted (top), with CD4-binding-site-directed antibody specificities (VRC01-, b12-, CD4-, and HJ16-like), 8ANC195-like, PG9-like (V1V2-directed), glycan V3 specificities (PGT128- and 2G12-like), 35O22-like specificities, and PGT151-like specificities indicated. FIG. 6B, (top) Broadly neutralizing epitopes on influenza virus hemagglutinin (left) and RSV fusion glycoprotein (right). (bottom) Glycan surface area and residue entropy in antibody epitopes for HIV-1, influenza, and RSV. FIG. 6C, Neutralization fingerprint. For each serum, the predicted neutralization prevalence for each of the 12 antibody specificities is shown based on neutralization of 21 diverse HIV-1 strains. FIG. 6D, Prevalence of antibody specificities onto the HIV-1-Env. FIG. 6E, Antibody specificities with high serum prevalence in the 5+ years cohort are depicted with antigen-binding fragments of representative antibodies (surface transparency proportional to prevalence) on the BG505 Env trimer, which is shown in cartoon representation, with glycans as sticks.

FIG. 7A, smFRET trajectories of the unliganded HIV-1$_{JR-FL}$ Env trimer. Similar histograms were obtained in the presence of PGT122 (FIG. 7B), 35O22 (FIG. 7C), and both PGT122 and 35O22 (FIG. 7D).

FIG. 8A, 35O22 Fab, gp120 subunit, gp41 subunit, and glycans are green. Complementary determining regions (CDRs) are labeled, and interactive HIV-1-Env residues highlighted in surface representation. At the membrane-distal surface of 35O22, an extended framework 3 region (FW3) of the heavy chain (resulting from an insertion of 8 residues) interacts with strand β1 of the 7-stranded inner domain sandwich of gp120. The heavy chain-CDRs from extensive contacts with the N-linked glycan extending from residue 88$_{gp120}$. In addition to glycan contacts, the CDR H3 of 35O22 interacts with the α9 helix of gp41. Helix α9 interactions are also made by the FW3 of the light chain (a complete list of contacts is provided in FIG. 28). Overall, 35O22 buries 1,105 Å$^2$ solvent surface on gp120 (including 793 Å$^2$ with the Asn88$_{gp120}$ glycan) and 594 Å$^2$ solvent surface on gp41 (including 127 Å$^2$ with the Asn618$_{gp41}$ glycan). Despite residue 625$_{gp41}$ being part of the glycan sequon "NMT", no glycan is observed; indeed, the side-chain amide of residue 625$_{gp41}$ hydrogen bonds with the side-chain oxygen of Tyr32 in the 35O22 heavy chain, and the presence of an N-linked glycan at residue 625$_{gp41}$ is difficult to reconcile with 35O22 recognition. FIG. 8B, 35O22 Fab shown in surface representation. FIG. 8C, $2F_o$-$F_c$ at 1σ contour shown around glycan 88 of gp120. Antibody 35O22 employs a novel mechanism of glycan-protein recognition, combining a protruding FW3 with CDR H1, H2 and H3 to form a "bowl" that holds glycan. FW3 and CDR H3 provide the top edges of the bowl and interact with the protein surface of gp120, whereas CDR H1 and H2 are recessed and hold/recognize glycan. This structural mechanism of recognition contrasts with the extended CDR H3-draping glycan observed with other antibodies that penetrate the glycan shield such as PG9 and PGT128.

FIG. 9 shows a comparison of bound and unbound Fab conformations. Unbound and HIV-1-Env bound Fabs were superimposed, and ribbon representations and rmsds are displayed here. (left), Regions which showed conformational changes are highlighted with black dotted lines. A complete list of contacts between PGT122 and BG505 SOSIP.664 is provided in FIG. 29).

FIGS. 10A and 10B show the principal component analysis of HIV-1 Env. Principle component analysis indicated each gp120-gp41 blade to form a rectangle, with height of ~100 Å, width of ~65 Å, and thickness of ~35 Å. FIG. 10A, Minimum bounding box, generated by principle component analysis, in shown encasing the HIV-1-Env gp120-gp41 protomer; subunits displayed in ribbon representation. As previously visualized (Walker, et al. *Nature* 477, 466-470 (2011)) the membrane-distal portion of the rectangle is made up of the gp120-outer and -inner domains, with the central 7-stranded β-sandwich of the inner domain occupying the trimer-distal, membrane-proximal portion of gp120. The rest of the ectodomain trimer is now resolved: the membrane-proximal portion of the rectangle is made up of gp41, with the membrane-distal portion of gp41 closest to the molecular 3-fold axis occupied by a helix (which corresponds in register to the C-terminal portion of the postfusion HR1 helix of gp41), and the rest of gp41 folding around N- and C-termini-strands of gp120, which extend over 20 Å toward the viral membrane. FIG. 10B, Different views of trimeric protomer association.

FIGS. 11A and 11B show the conformational changes between gp120 prefusion and CD4-bound state. FIG. 11A, gp120 from BG505 (positions 31-511 of SEQ ID NO: 2) is shown in cartoon representation in prefusion (dark grey) and CD4-bound (light grey, PDB ID 3JWD) conformation. V1V2 (PDB ID 3U2S) has been modeled onto the CD4-bound conformation. Secondary structure changes from prefusion to CD4-bound conformation are shown with cylinders representing α-helix and arrows β-strands. Disordered residues are indicated by "X". Residues that move more than 3 Å between the prefusion and the CD4-bound conformations are shown with grey shadows. FIG. 11B, Details of conformational changes between the prefusion and the CD4-bound conformation of gp120 (shown in cartoon): regions highlighted cover layer 1 with α0 changes, layer 2 with α1 changes and β20-21 rearrangements. All atoms rmsd for the following region are: for residues 54-74 in gp120, rmsd=4.759; for residues 98-117 in gp120, rmsd=0.497; for residues 424-436 gp120, rmsd=3.196. FIG. 11A is produced in color as extended data FIG. 4*a* in Pancera et al., Nature, 514(7523, 455-461, 2014, extended data FIG. 4*a* of Pancera et al. is incorporated by reference herein.

FIGS. 12A-12C show the relative protein surface occlusion by glycans. The solvent-accessible protein surface is shown in red and N-linked glycans are shown in green. Calculations of the percentage coverage of the protein surface were determined for the four trimer models based on two probe sizes of 1.4 Å (solvent radius) and 10.0 Å (the estimated steric footprint of an antibody combining region). FIG. 12A, Estimated Man-9 glycan coverage. FIG. 12B, Estimated Man-5 glycan coverage. FIG. 12C, Visualization of Man-9 N-linked glycan coverage for two probe radii. Surface area calculations were carried out according to Kong et al. (Kong, et al. *Journal of molecular biology* 403, 131-147 (2010)) and images were generated using Grasp v1.3 (Nicholls, et al. *Proteins* 11, 281-296 (1991)). The PDB IDs associated with the glycosylated models are: 4TVP (HIV-1), 2YP7 (Flu) and 4JHW (RSV).

FIGS. 13A and 13B show the prevalence of neutralizing responses identified serologically from cohorts from (FIG. 13A) years 2-3 and (FIG. 13B) years 5+ post infection. For each serum, the predicted neutralization prevalence for each of 12 antibody specificities is shown based on neutralization of 21 diverse HIV-1 strains. Serum neutralization on 21-strain virus panel is shown in FIG. 30.

FIG. 14 is a table providing data collection and refinement statistics for the BG505.SOSIP.664-PGT122-35O22 protein complex structure.

FIG. 15 is a table listing the modeling parameters for gp120 and gp41 rearrangements. To provide reference frames for the various prefusion conformational states, we extracted Env component of SOSIP bound by VRC-PG04 (Lyumkis, et al. *Science* 342, 1484-1490 (2013)) and by VRC03 (Bartesaghi, et al. *Nature structural & molecular biology* 20, 1352-1357 (2013)) and the resultant maps with the CD4-bound conformation trimeric BAL (Tran, et al. *PLoS pathogens* 8, e1002797 (2012)). Once maps were aligned, gp120 and gp41 models were fit to each of the maps as defined in the table in black text after "gp120" and "gp41". In addition to rigid-body fits of crystal structures, specific regions of gp120 and gp41 were modeled and are defined in the table in red text after different portions of gp120 and gp41 relative to the prefusion mature closed conformation.

Figure 1A:
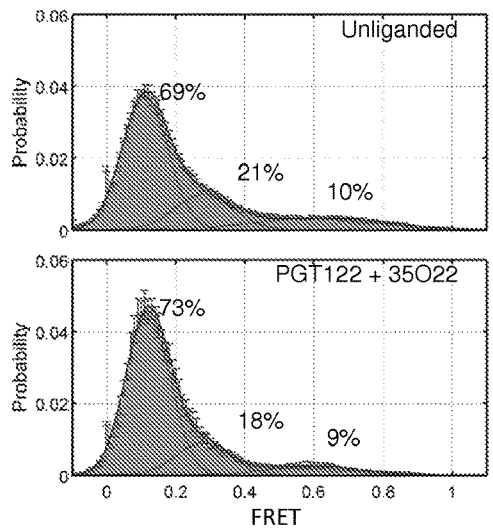
FIGS. 1A and 1B illustrate the structure of a prefusion HIV-1-Env trimer bound by PGT122 and 35O22 antibodies.

The prefusion mature closed conformation of gp120 and gp41 was established from the crystal structure presented in Example 1 and was fit without modification to EMDB-5779 with density from PGV04 fabs computationally removed. The prefusion partially open intermediate conformation was modeled by a rigid body fitting of gp120 to EMDB-2484 with density from VRC03 Fabs computationally removed. α7 of gp41 was extended into the unoccupied density at the N-terminus of the helix using the mature closed structure as a starting model. The prefusion receptor-bound intermediate was modeled by fitting the CD4-bound gp120 core crystal structure (PDB ID 3JWD) to the CD4-bound EMDB-5455 map. V3 of the crystal structure (PDB ID 3HI1) was aligned to the core and the V1V2 crystal structure (PDB ID 3U4E) was fit to the remaining density. α7 of gp41 was extended through an alignment with crystal structures of postfusion gp41 (PDB IDs 2X7R, 2EZO). Postfusion gp120 is in the same conformation as the prefusion receptor-bound intermediate and the postfusion gp41 structure was derived from an alignment of SIV and HIV postfusion crystal structures (PDB IDs 2X7R, 2EZO).

FIGS. 16A and 16B are tables showing binding parameters of the 35O22, PGT151, and PGT145 antibodies to trimeric BG505 SOSIP.664. *NBD: No binding detected, (double dagger) SE: Standard error calculated from global fit of 6 independent injections. FIG. 16A: # Levels of captured trimer varied between 400-500 RU for the CD4 Ig and 2G12 captures, whereas ~1500 RUs of trimer (+sCD4) was captures in the 17b capture format. FIG. 16B: SE: Standard error calculated from global fit of 6 independent injections; SD: Standard deviation of trimer capture from 6 independent injection; Normalized: ($R_{max}$/Level of trimer capture)*100.

FIG. 17 is a table showing the atomic-level structures for HIV-1-Env regions determined in complex with HIV-1-neutralizing antibodies. Neutralizing antibodies generally recognize the prefusion conformation of HIV-1 Env. Thus structures highlighted here display a cumulative sum total of prefusion HIV-1-Env structural information. Env residues are numbered according to standard HXB2 numbering (from PDBs). One structure, for antibody D5, is in the postfusion gp41 conformation, and is thus not included in the sum total. Other structures for PDB 4CC8, 4NCO, and 3J5M, do not define sequence register, and are also not included in the sum total.

FIGS. 18A-18C show biolayer interferometry binding profiles of monoclonal antibodies to BG505 SOSIP.664. Octet Biosensorgrams of BG505 SOSIP.664 (FIG. 18A) or BG505 gp120 (FIG. 18B) binding to human monoclonal IgGs. Human monoclonal antibodies were loaded onto AMC probes and association with gp140 or gp120 proteins (at 50 µM concentration) were allowed to proceed for 300s, followed by dissociation for 300s with the responses measured in nm using an Octet Red 384 machine. All experiments were carried out at 30° C. in PBS buffer (pH 7.4) supplemented with 1% BSA to minimize non-specific binding. The dotted line indicates the beginning of the dissociation phase and the maximal specific binding after 300s reported in the table shown in FIG. 18C (− no binding, + from background to 0.175 RU, ++ 0.175 RU to 0.35 RU and +++ from 0.35 RU to 0.8 RU). BG505gp120 did not contain the T332N mutation (no glycan at that position). The antigenicity of the BG505 SOSIP.664 protein varied depending on the assay done. Thus, using surface plasmon resonance, no CD4i antibodies binding was detected while some binding could be observed using biolayer interferometry.

Figure 19A:
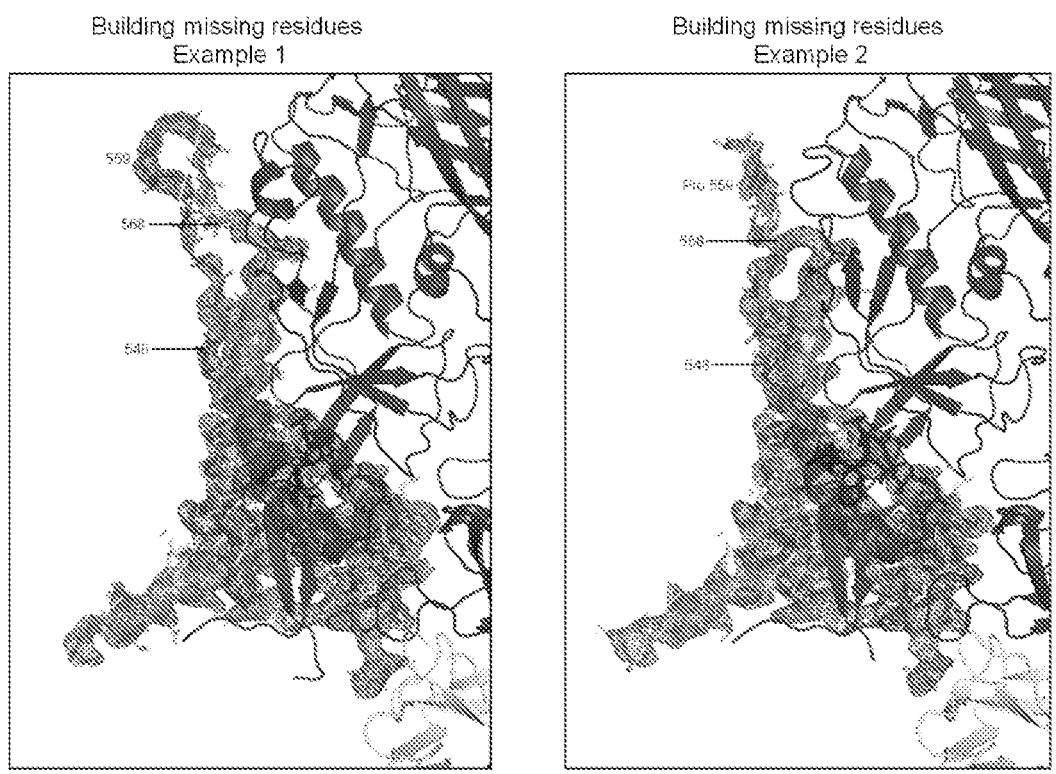
Figure 19B:
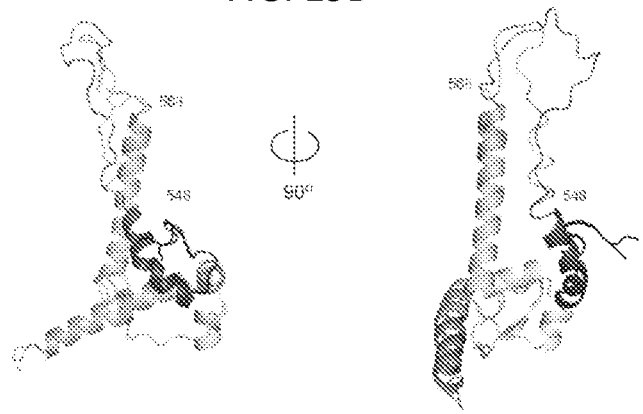

FIGS. 19A-19B are a set of ribbon diagrams showing modeling of gp41 residues 548-568. At low contour, suggestive density is observed that might correspond to the connection between α6 and α7 helices. To investigate the degree to which a model for this region might be defined, two different models for this region were built and refined, as shown in FIG. 19A, with electron density shown for $2F_o-F_c$ density at 1σ contour. The location of the I/P mutation at 559 is indicated. FIG. 19B, Superimposed models shown in perpendicular orientations.

Figure 20A:
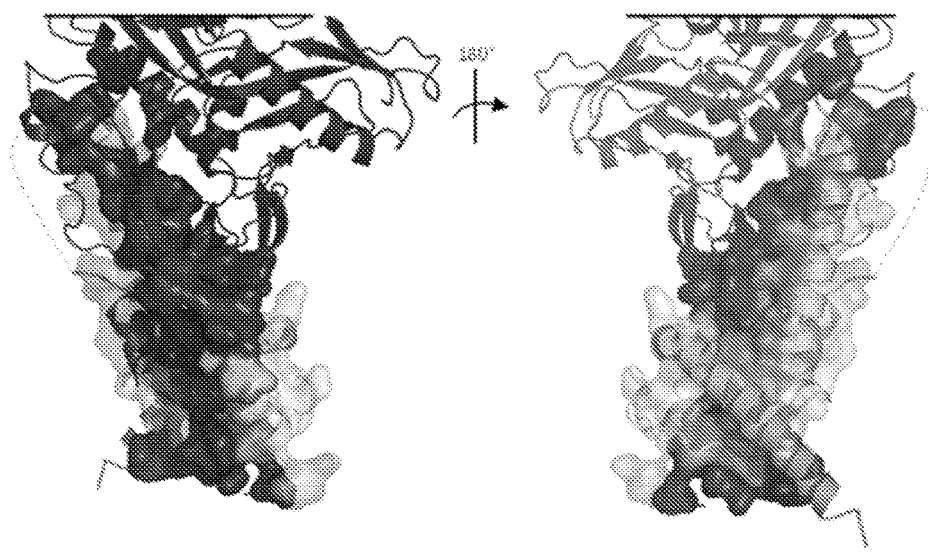
Figure 20B:
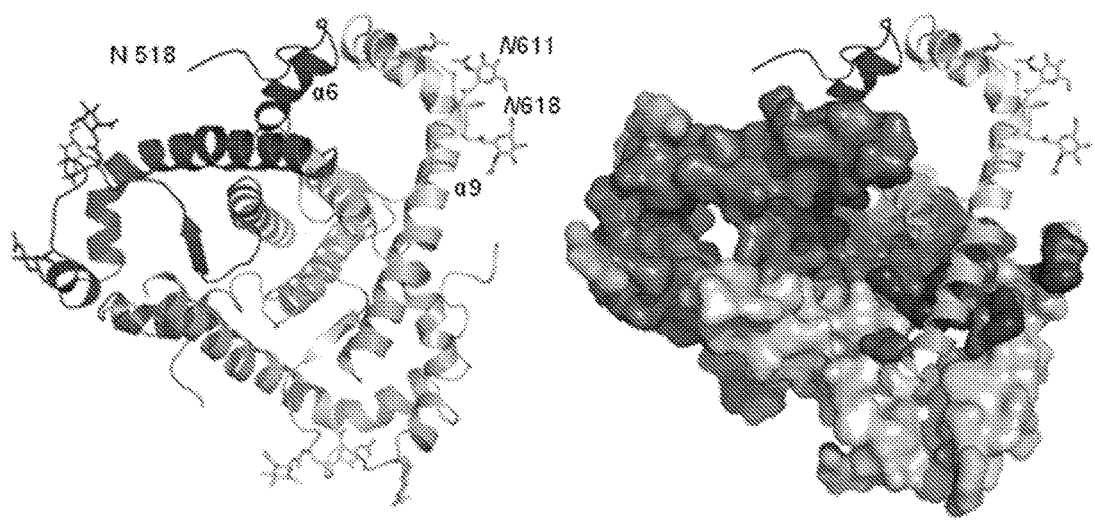
Figure 20C:
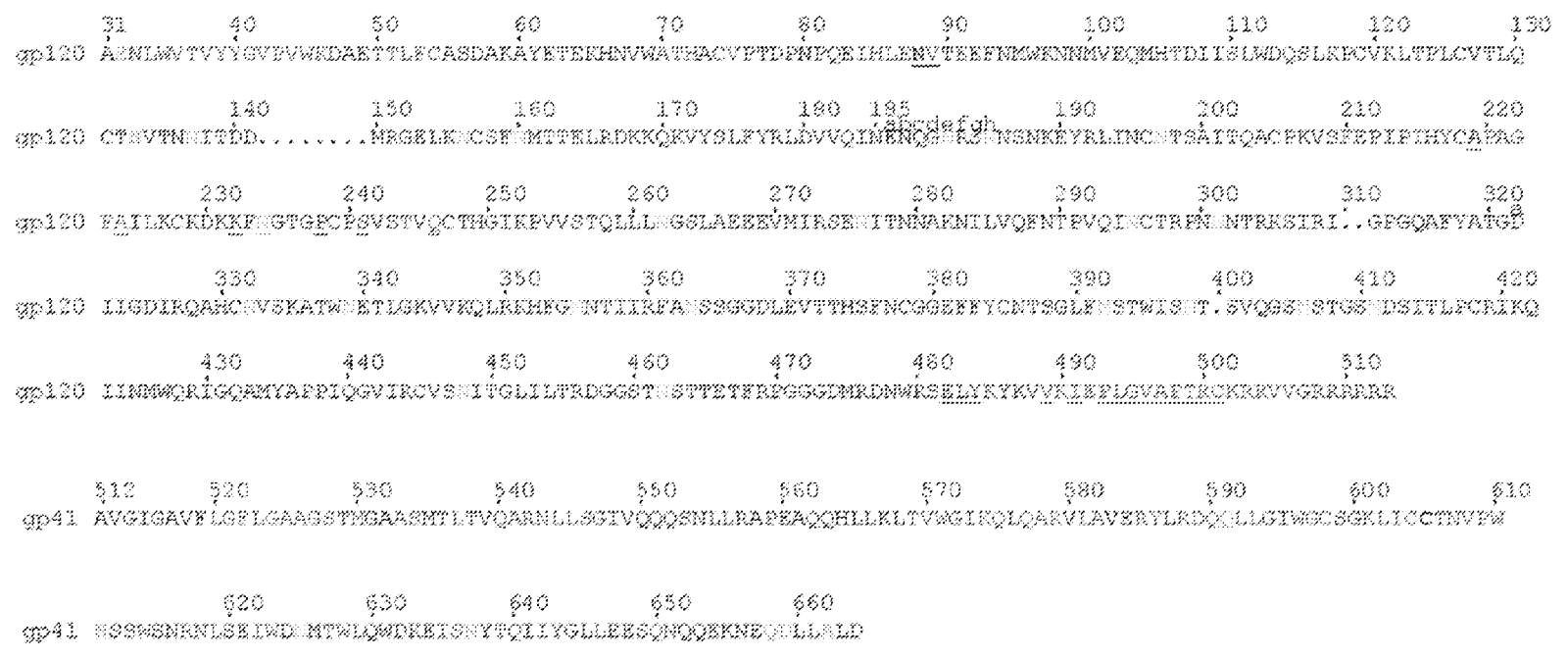

FIGS. 20A-20C illustrate the gp120-gp41 and gp41-gp41 interfaces. FIG. 20A, Cartoon representation of gp120 and gp41. Region of gp120 that interacts with gp41 is shown in surface representation and region of gp41 that interacts with gp120 is shown in semitransparent surface. FIG. 20B, gp41-trimer interfaces as viewed from the viral membrane in ribbon and surface representation (90° rotation from FIG. 2C). FIG. 20C, Residues that have been shown by mutagenesis (Helseth et al., *J Virol*, 65, 2119-2123 (1991); Thali et al., *J Virol*, 66, 5516-5524 (1992); Cao, J. et al. *J Virol*, 67, 2747-2755 (1993); Leavitt et al., *J Virol*, 77, 560-570 (2003); Yang et al., *Virology* 313, 117-125 (2003); Sen et al., *Biochemistry* 47, 7788-7795 (2008); Wang et al., *J Biol Chem* 283, 32644-32649 (2008)) to be important for gp120/gp41 association are underlined on sequence and residues that are shown to interact between gp120 and gp41 from the crystal structure are indicated in red from the same protomer and in orange if between two protomers. The sequence of HIV-1 Env ectodomdina from BG505 (positions 31-664 of SEQ ID NO: 2 is shown). Sites of N-linked glycosylation are shown in green.

Figure 21:
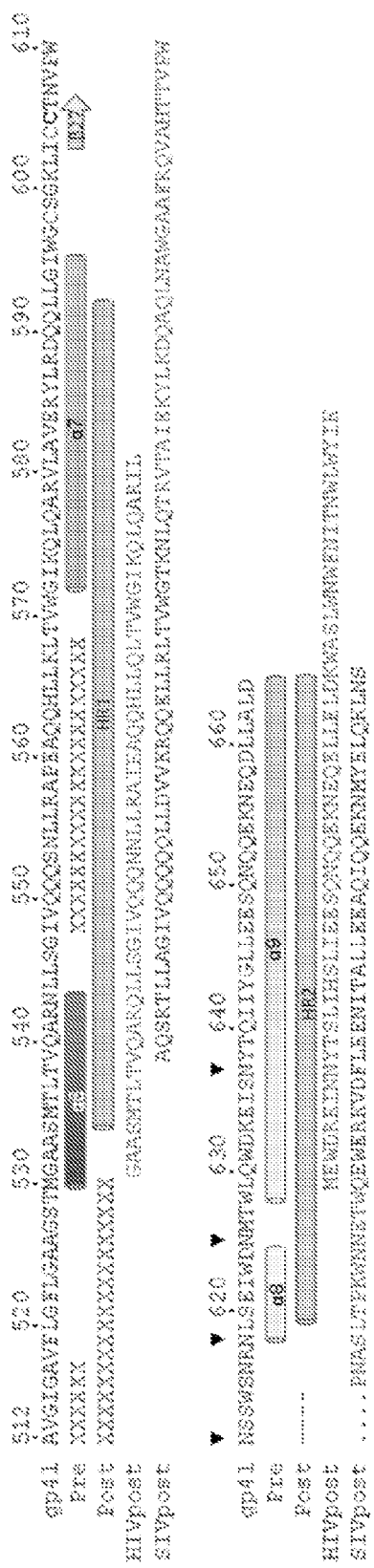

FIG. 21 illustrates HIV-SIV postfusion chimera. Sequences of HIV-1 gp41 prefusion, postfusion (HIVpost, PDB ID: 2X7R) and SIV gp41 postfusion (SIVpost, PDB ID: 2EZO) are aligned with secondary structure indicated. Residues that were used to make the postfusion HIV-1/SIV chimera used in FIG. 3 are shown in red.

Figure 22A:
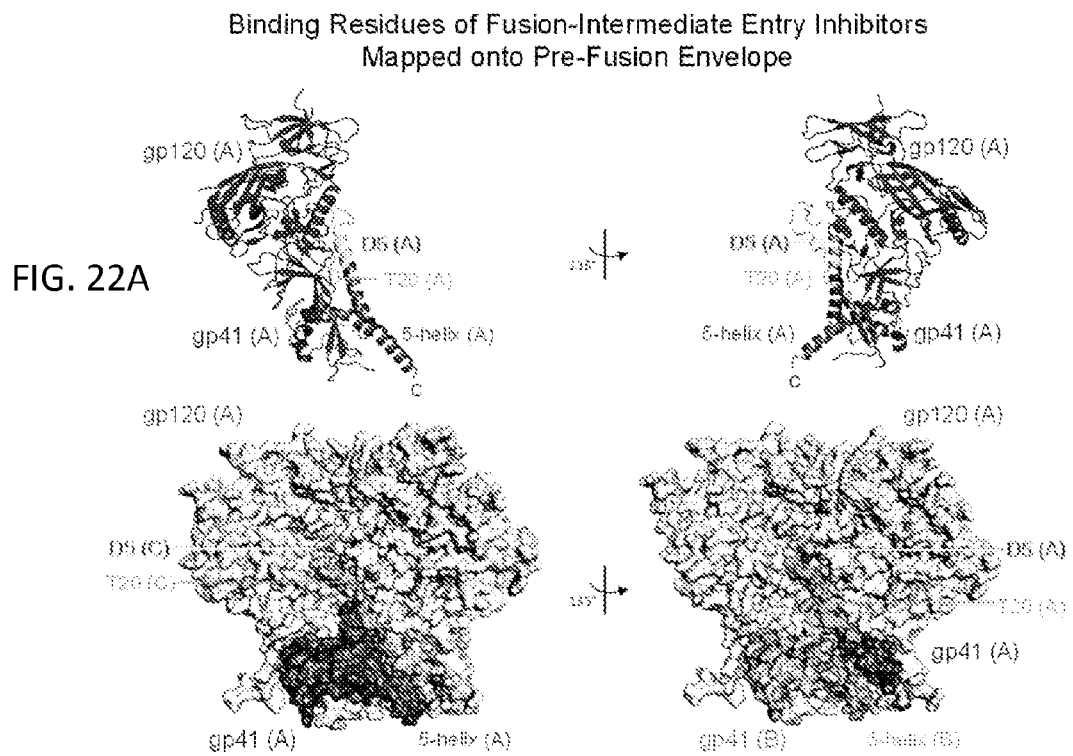

FIGS. 22A and 22B illustrate the fusion-intermediate entry inhibitors of HIV-1 envelope. FIG. 22A, The binding residues of representative fusion-intermediate targeting entry inhibitors or antibodies were mapped onto the structure of pre-fusion envelope (Lawless et al., *Biochemistry* 35, 13697-13708 (1996); Chen et al., *J Virol*, 69, 3771-3777 (1995); Root et al., *Science* 291, 884-888 (2001)). Upper panels, ribbon representation of pre-fusion envelope protomer A, at two orientations, with the binding residues of the fusion-intermediate inhibitors 5-helix, T20, and monoclonal antibody D5 indicated. Lower panels, surface representation of the pre-fusion envelope trimer, with the fusion-intermediate binding residues mapped onto the surfaces of all protomers. gp120 is colored lighter gray and gp41 is colored darker grey. Binding residues of fusion-intermediate inhibitors 5-helix, T20, and monoclonal antibody D5 (Luftig et al., *Nature structural & molecular biology* 13, 740-747 (2006)) are indicated. FIG. 22B, Fusion-intermediate entry inhibitors T20, 5-helix, and D5 Fab docked onto a model of fusion-intermediate gp41.

FIG. 23 shows a set of graphs showing the effect of CD4 and CD4/17b on binding of antibodies 35O22 and PGT151 to BG505 SOSIP.664. The structure of a near-native prefusion state of HIV-1 provides a critical addition to the pantheon of HIV-1 Env structures with atomic-level detail. Moreover, antibodies 35O22 and PGT151, which bind specifically to the trimeric prefusion conformation of gp41, provide new tools by which to assess the conformational state of gp41 (Blattner et al., *Immunity* 40, 669-680 (2014); Falkowska et al., *Immunity* 40, 657-668 (2014). The binding of antibodies 35O22 and PGT151 to BG505 SOSIP.664 trimer was tested in the presence of the CD4 receptor and the 17b antibody (Thali et al., *J Virol*, 67, 3978-3988 (1993) (a co-receptor surrogate which recognizes a bridging sheet epitope that overlaps the site of co-receptor recognition). In the case of antibody 35O22, CD4 binding to the BG505 SOSIP.664 trimer impacted the kinetics, affinity and stoichiometry of binding. 35O22 bound to BG505 SOSIP.664 with an 8.4-fold reduced affinity, primarily contributed by an increased rate of dissociation. The overall binding level (Rmax) normalized to the average level of trimer captured (see also FIG. 16) was lower suggesting substoichiometric binding. Capturing the trimer on a CD4-Ig surface reduced normalized $R_{max}$ for PGT151 compared to the 2G12 capture format, suggesting reduced stoichiometry for PGT151 binding to trimer pre-bound with CD4, although kinetics and affinity of interaction were similar. A BG505 SOSIP.664 trimer+sCD4 complex captured onto a 17b surface bound 35O22 but showed no detectable binding to PGT151.

Figures 24A, 24B:
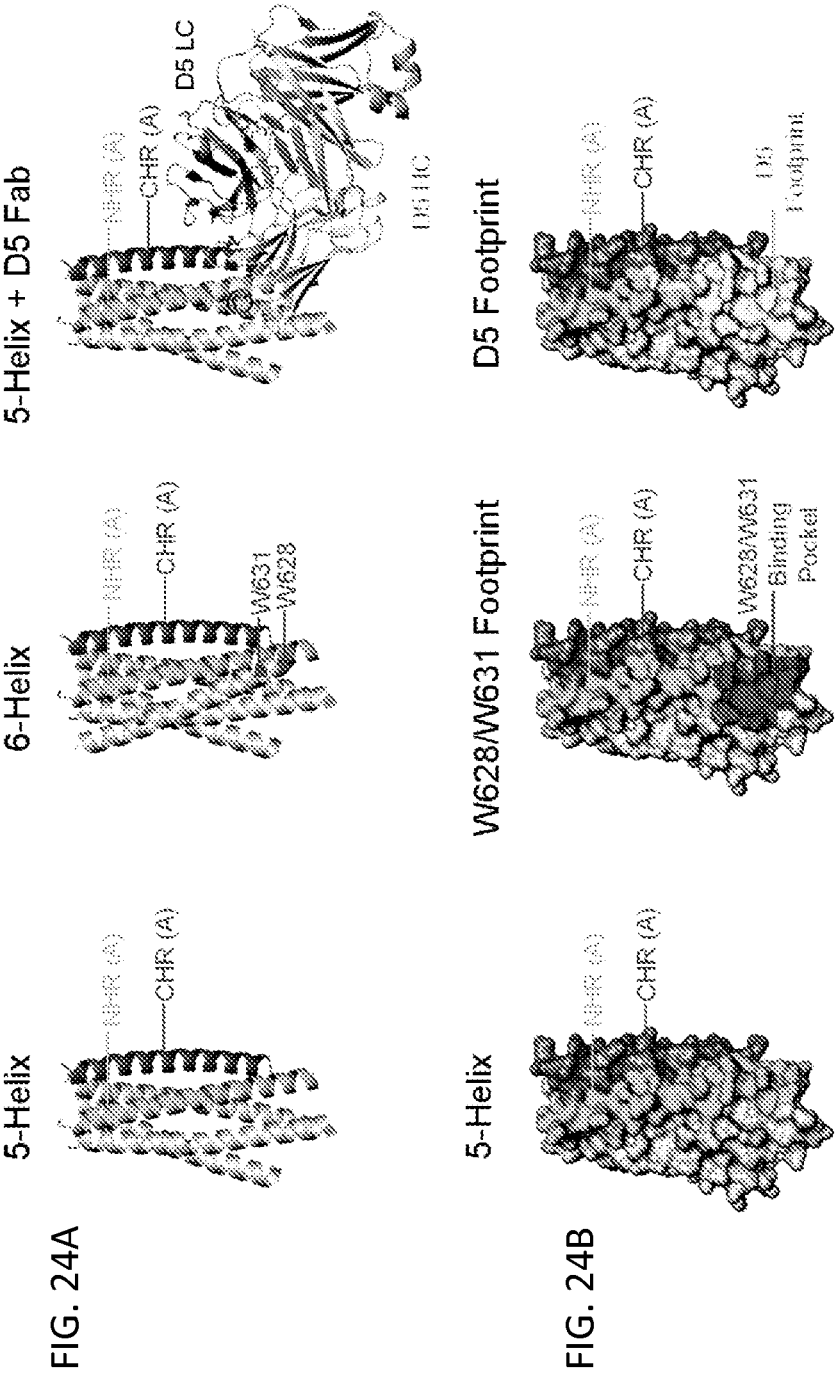

FIGS. 24A and 24B illustrate the postfusion binding pocket of gp41 clasp residues Trp628 and Trp631 is targeted by neutralizing antibodies. FIG. 24A, Shown are ribbon representations of gp41 5-helix protein (Root, et al 2001) (left) docked with an additional C-heptad repeat (CHR) helix (middle panel) or with a representative neutralizing antibody, D5, that targets this site (Luftig et al., *Nature structural & molecular biology* 13, 740-747 (2006); Gustchina et al., *PLoS pathogens* 6, e1001182 (2010); Sabin et al., *PLoS pathogens* 6, e1001195 (2010)) (right panel). Residues of the prefusion clasp, W628 and W631, that are part of CHR are indicated. N-heptad repeat (NHR) helices and CHR helices are indicated. FIG. 24B, Surface representation of 5-helix protein (same orientation and coloring as in FIG. 24A) is shown with the footprints of gp41 clasp residues W628 and W631 (middle panel) and antibody D5 (right panel).

FIGS. 25A-25E are a set of tables showing binding and contact parameters for the gp120-gp41 interface in the HIV-1 viral spike. D: Disulfide bond, H: Hydrogen bond, S: Salt bridge. ASA: Accessible Surface Area, Å$^2$, BSA: Buried Surface Area, Å$^2$, ΔiG: Solvation energy effect, kcal/mol, ||||: Buried area percentage, one bar per 10%.

FIG. 26 is a table and a set of ribbon diagrams illustrating structures that are related to the gp120/gp41 structure in the prefusion mature closed conformation of the HIV-1 Env ectodomain trimer.

FIGS. 27A and 27B illustrate qualitative recognition of HIV-1 envelope by diverse antibodies is shown for five conformational states. Light grey bars indicate anticipated recognition, dark grey bars no recognition, and absence of a bar indicates that recognition is undefined. HIV-1 recognition is from cited references (Luftig et al., *Nature structural & molecular biology* 13, 740-747 (2006); Blattner et al., *Immunity* 40, 669-680 (2014); Gustchina et al., *PLoS pathogens* 6, e1001182 (2010); Sabin et al., *PLoS pathogens* 6, e1001195 (2010); Liao et al., *Nature* 496, 469-476 (2013); Zhou et al., *Science* 329, 811-817 (2010); Scheid et al., *Science* 333, 1633-1637 (2011); Sanders et al., *PLoS pathogens* 9, e1003618 (2013); Yasmeen et al., *Retrovirology* 11, 41 (2014); Lyumkis et al., *Science* 342, 1484-1490 (2013); Ringe et al., *PNAS USA* 110, 18256-18261 (2013); Julien et al., *Science* 342, 1477-1483 (2013); Walker et al., *Nature* 477, 466-470 (2011); Stanfield et al., *Human antibodies* 14, 73-80 (2005); Pancera et al., *PNAS USA* 107, 1166-1171 (2010); Huang et al., *Science* 310, 1025-1028 (2005); Huang et al., *Science* 317, 1930-1934 (2007); Rizzuto et al., *Science* 280, 1949-1953. (1998); Guan et al., *PNAS USA* 110, E69-78 (2013); Gorny et al., *Virology* 267, 220-228 (2000); Yuan et al., *AIDS research and human retroviruses* 25, 319-328 (2009); Moore et al., *J Virol*, 80, 2515-2528 (2006); Miller et al., *PNAS USA* 102, 14759-14764 (2005); Chen et al., *J Virol*, 88, 1249-1258 (2014); Chakrabarti et al., *AIDS research and human retroviruses* 27, 877-887 (2011); Frey et al., *PNAS USA* 105, 3739-3744 (2008); Nicely et al., *Nature structural & molecular biology* 17, 1492-1494 (2010); Huang et al., *Nature* 491, 406-412 (2012)) or from antibodies 35O22 and PGT151 recognition of HIV-1 Env as shown herein (see FIG. 16).

FIGS. 28A-28D and 29A-29D show a set of tables listing binding and contact parameters for the interaction of the 35O22 heavy and light chains variable regions with the trimeric HIV-1 Env ectodomain. D: Disulfide bond, H: Hydrogen bond, S: Salt bridge. ASA: Accessible Surface Area, Å$^2$, BSA: Buried Surface Area, Å$^2$, ΔiG: Solvation energy effect, kcal/mol, ||||: Buried area percentage, one bar per 10%.

FIGS. 30A and 30B are a set of tables listing serum neutralization results from a 21-strain virus panel.

FIG. 31 is a schematic diagram illustrating structural implementation of HIV-1 evasion.

Figure 32A:
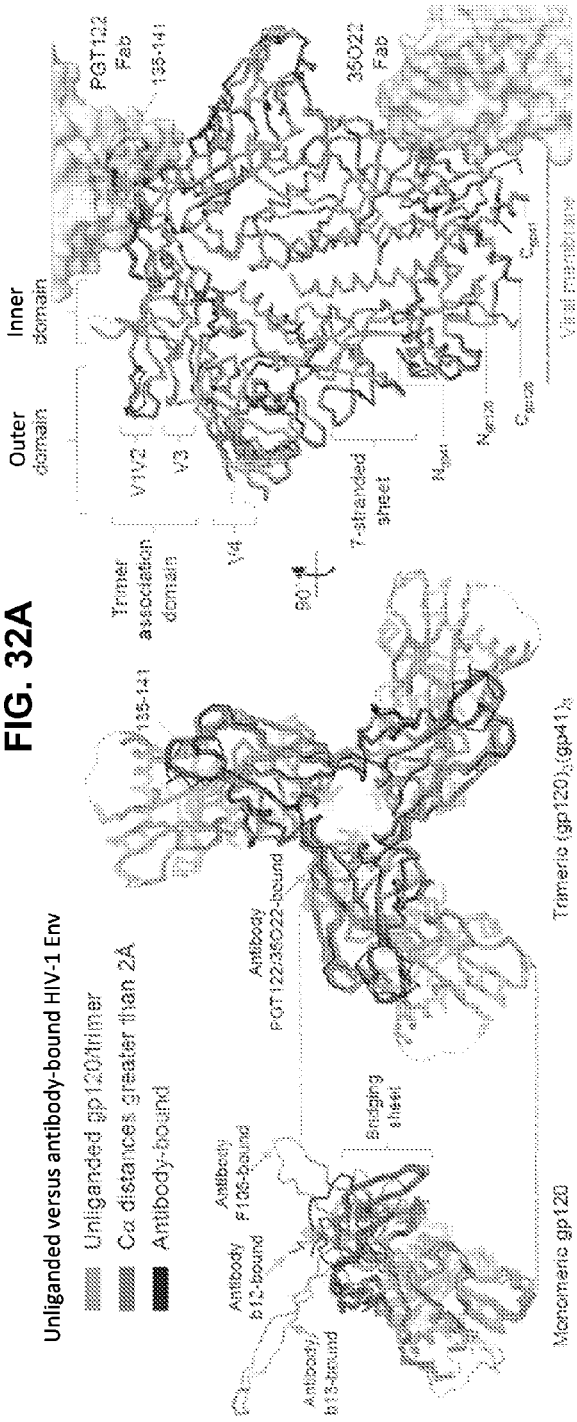
Figure 32B:
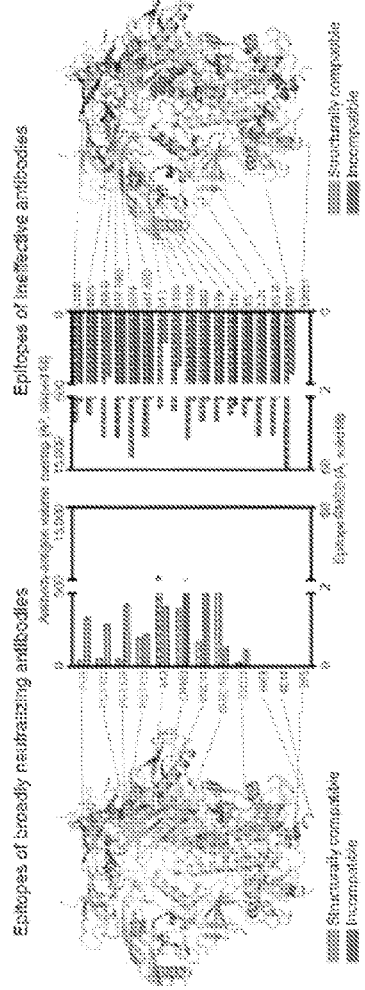
Figure 32C:
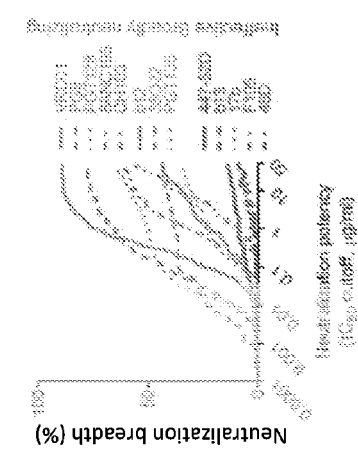
Figure 32D:
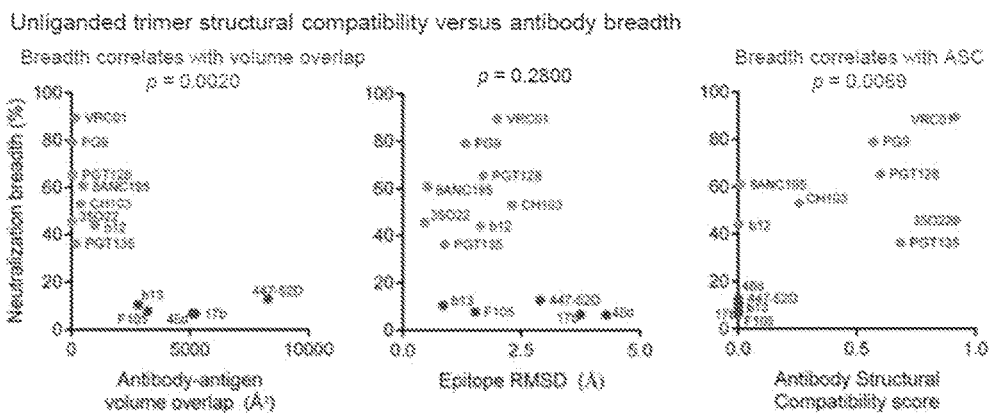

FIGS. 32A-32D are a set of ribbon diagrams and graphs illustrating that the unliganded HIV-1 Env trimer is structurally compatible with epitopes of broadly neutralizing but not ineffective antibodies. FIG. 32A, Superposition of unliganded and antibody bound HIV-1 Env structures. (Left) The unliganded gp120 core monomer is shown in ribbons representation, with regions of less (or greater) than 2 Å RMSD upon antibody binding indicated, and representative antibody-bound structures in black. (Middle and right) Unliganded and antibody-bound HIV-1 Env trimers. (In the right panel, antibodies PGT122 and 35O22 are shown in gray semitransparent surfaces, and the rear protomer has been removed for clarity). FIG. 32B, Breadth-potency of broadly neutralizing and ineffective antibodies on a diverse 170 HIV-1 isolate panel. FIG. 32C, Unliganded Env structure is displayed as a Cα-ribbon, with antibody epitope residues light grey (structurally compatible) or dark grey (incompatible). RMSD (solid fill) and volume overlap (striped fill) with the respective antibody-Env complexes are shown as a bar graph, with two linear scales split at the RMSD and antibody-antigen volume overlap cutoffs of 2 Å and 500 Å$^3$, respectively; bars below the respective cutoffs. Antibody labels are dark grey if incompatible, and gray if not present in the structure. FIG. 32D, Structural compatibility versus breadth. Volume overlap (left), RMSD (middle) and Antigenic Structural Compatibility score (ASC) (right) are graphed versus antibody breadth on a diverse 170 HIV-1 isolate panel. P-values for Spearman correlations provided.

Figure 33A:
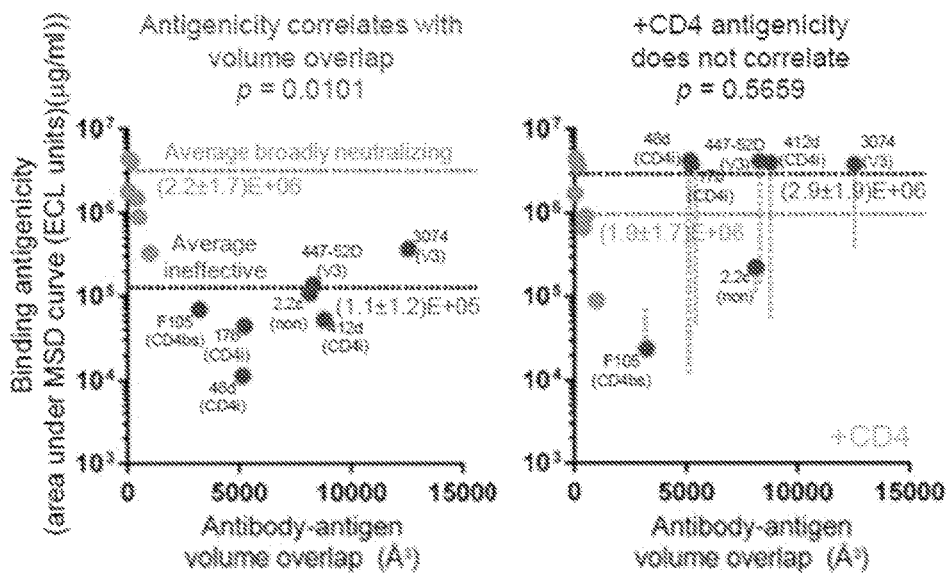
Figure 33B:
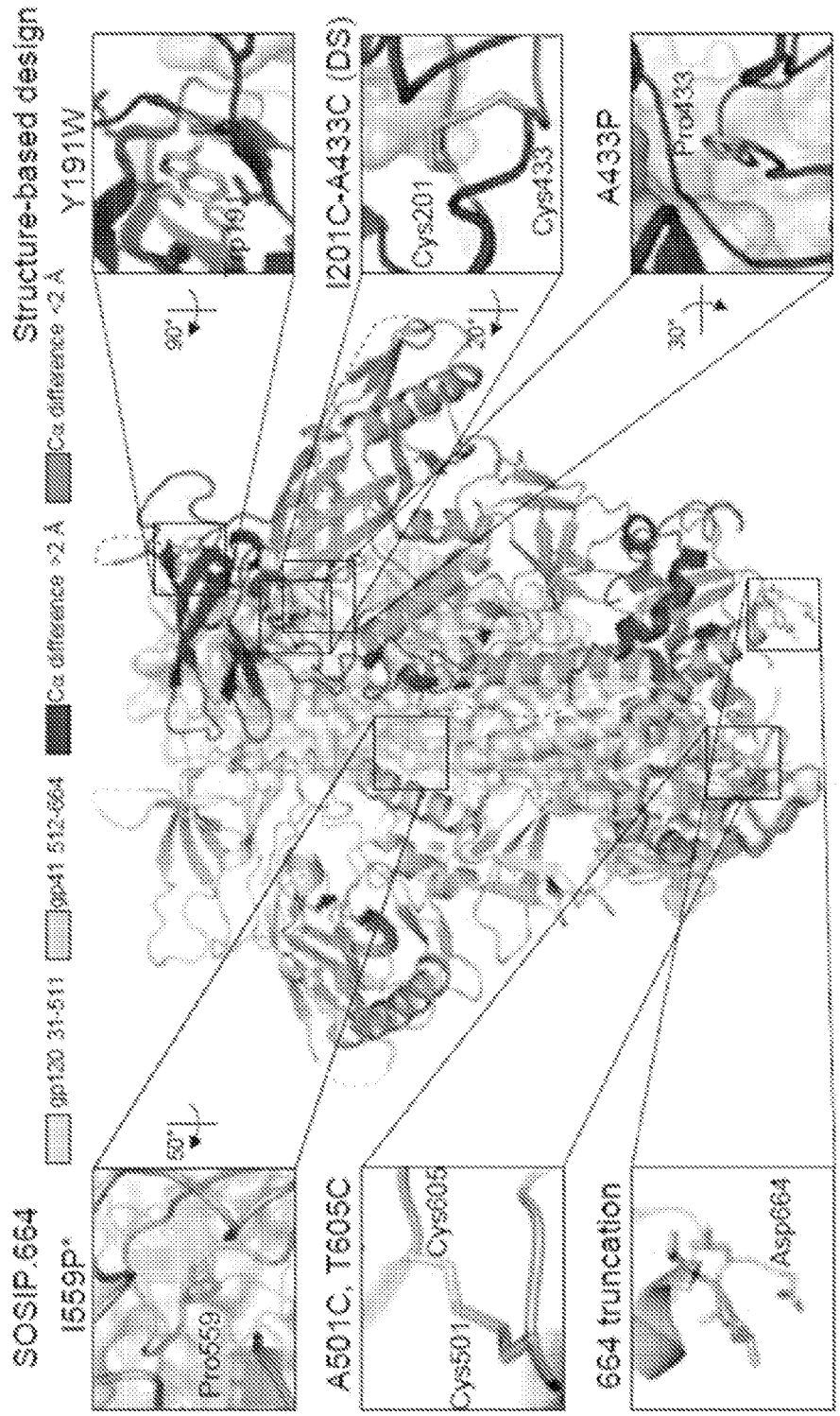
Figure 33E:
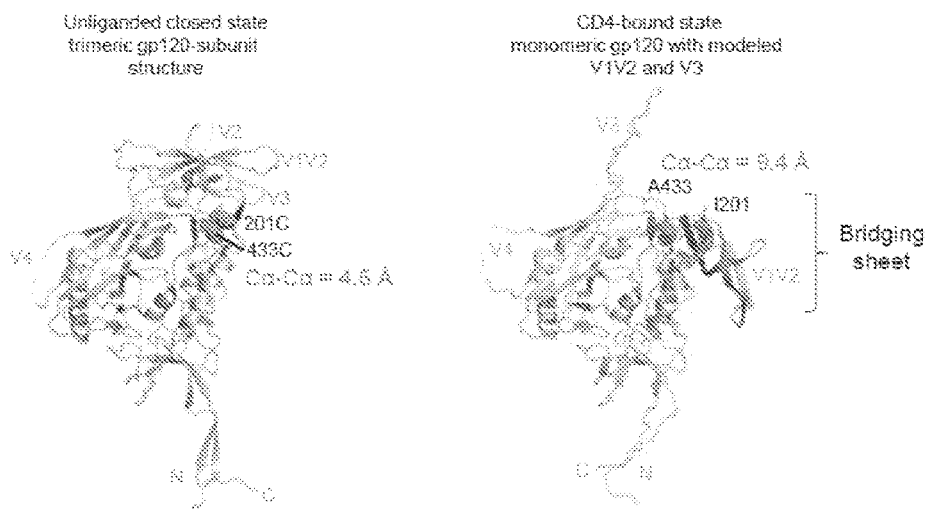
Figure 33F:
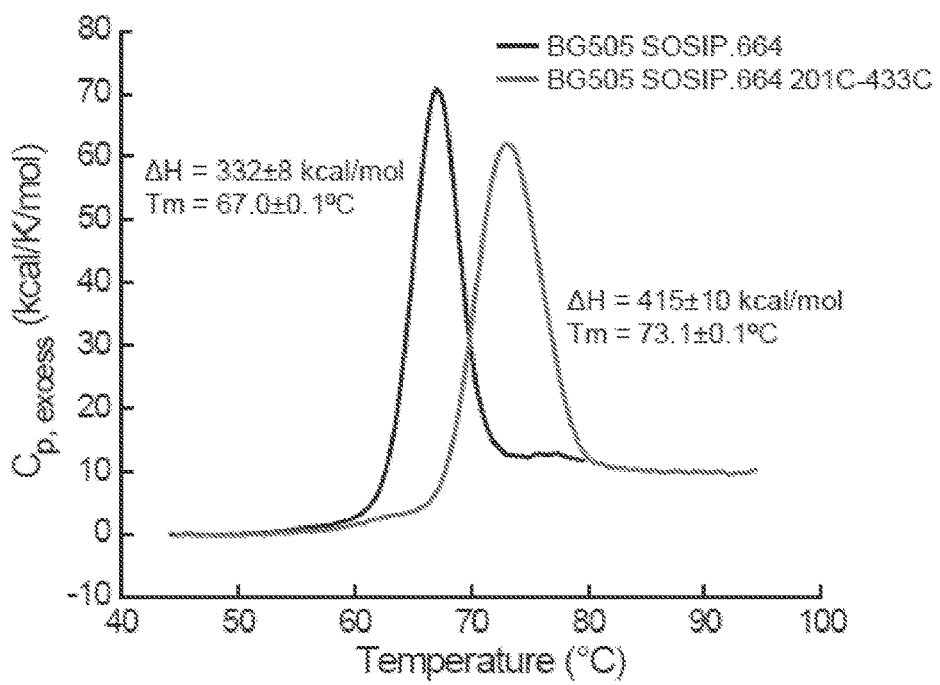

FIGS. 33A-33F are a set of diagrams and graphs illustrating the antigenicity and conformational fixation of unliganded HIV-1 Env. FIG. 33A, BG505 SOSIP.664 structural compatibility versus binding antigenicity, in the absence (left) and presence (right) of CD4; average binding of each antibody is provided, and ineffective antibodies labeled (CD4bs:CD4-binding site, CD4i: CD4-induced, non: non-neutralizing, V3: V3-loop directed). FIG. 33B, Conformationally stabilized BG505 SOSIP.664 variants. The central image depicts the unliganded BG505 SOSIP.664 HIV-1 Env trimer, with two protomers shown in cartoon representation. Insets: atomic-level details. *Residue 559 is disordered in the unliganded structure. FIG. 33C, Binding antigenicity of BG505 SOSIP.664 and alterations to BG505 SOSIP.664 that stabilize the unliganded closed state. Heat map shows binding of BG505 SOSIP.664 and variants to a panel of antibodies. A433P was temporally less stable than 201C-433C (Extended Data FIG. 6b) FIG. 33D, Structure of BG505 SOSIP.664 201C-433C is compatible with binding antigenicity, in both the absence (left) and presence (right) of CD4, with antibodies and average binding of broadly neutralizing and ineffective antibodies as in FIG. 33A. FIG. 33E, Atomic-level models of residues 201 and 433 in unliganded prefusion closed and CD4-bound conformations. Ribbon representation of the two structures are shown with bridging sheet shown in dark grey, residues 201 and 433 highlighted and Cα distance between the two indicated. Positions of the variable loops are shown. (Monomeric CD4-bound conformation from PDB ID 3JWD, 3U4E and 2B4C.) FIG. 33F, Differential scanning calorimetry.

Figure 34A:
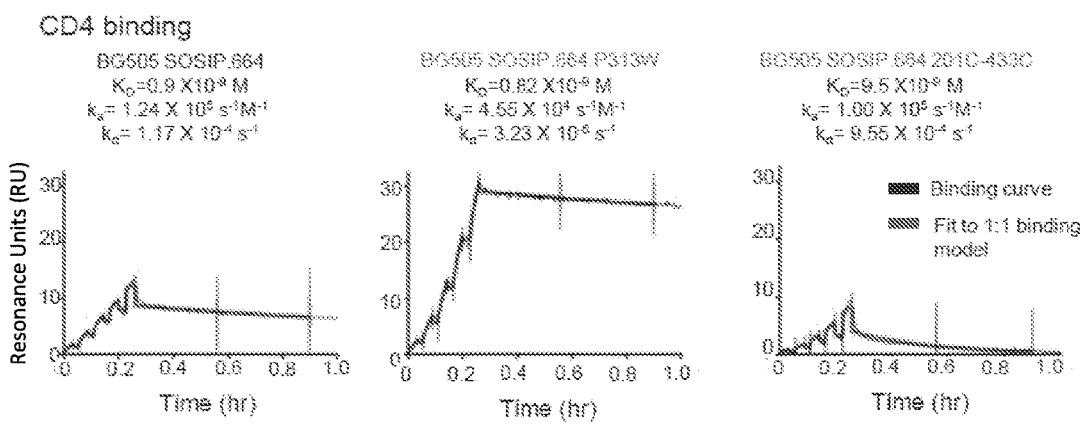
Figure 34B:
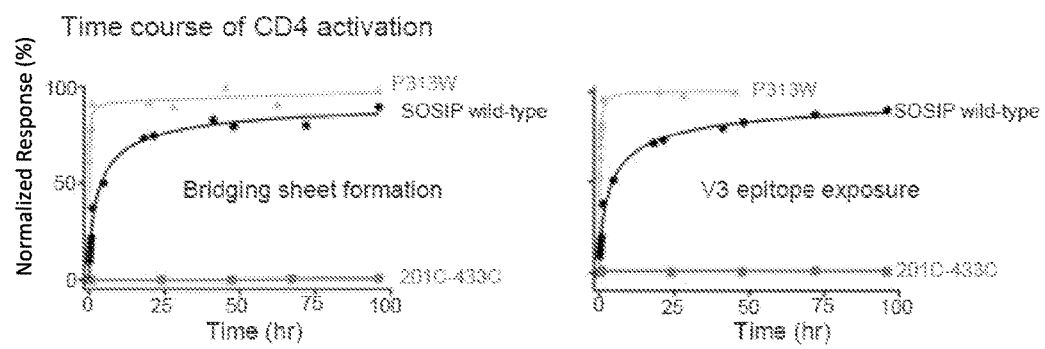
Figure 34C:
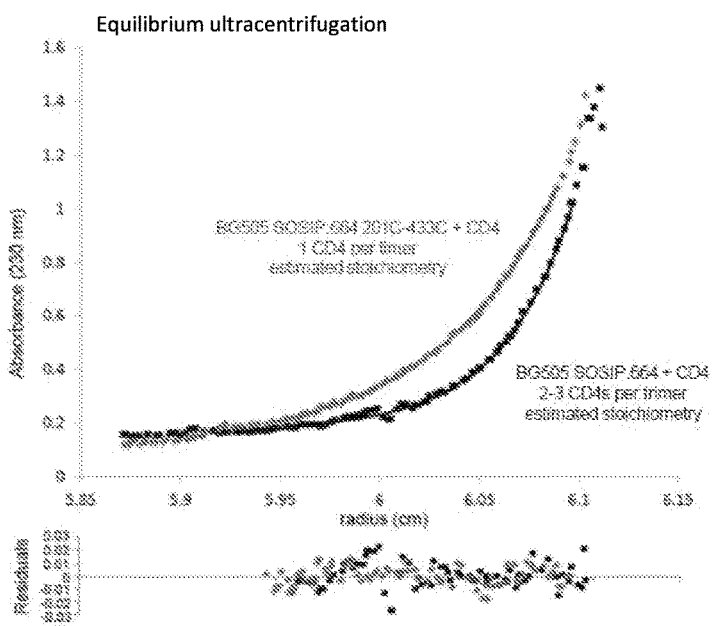
Figure 34D:
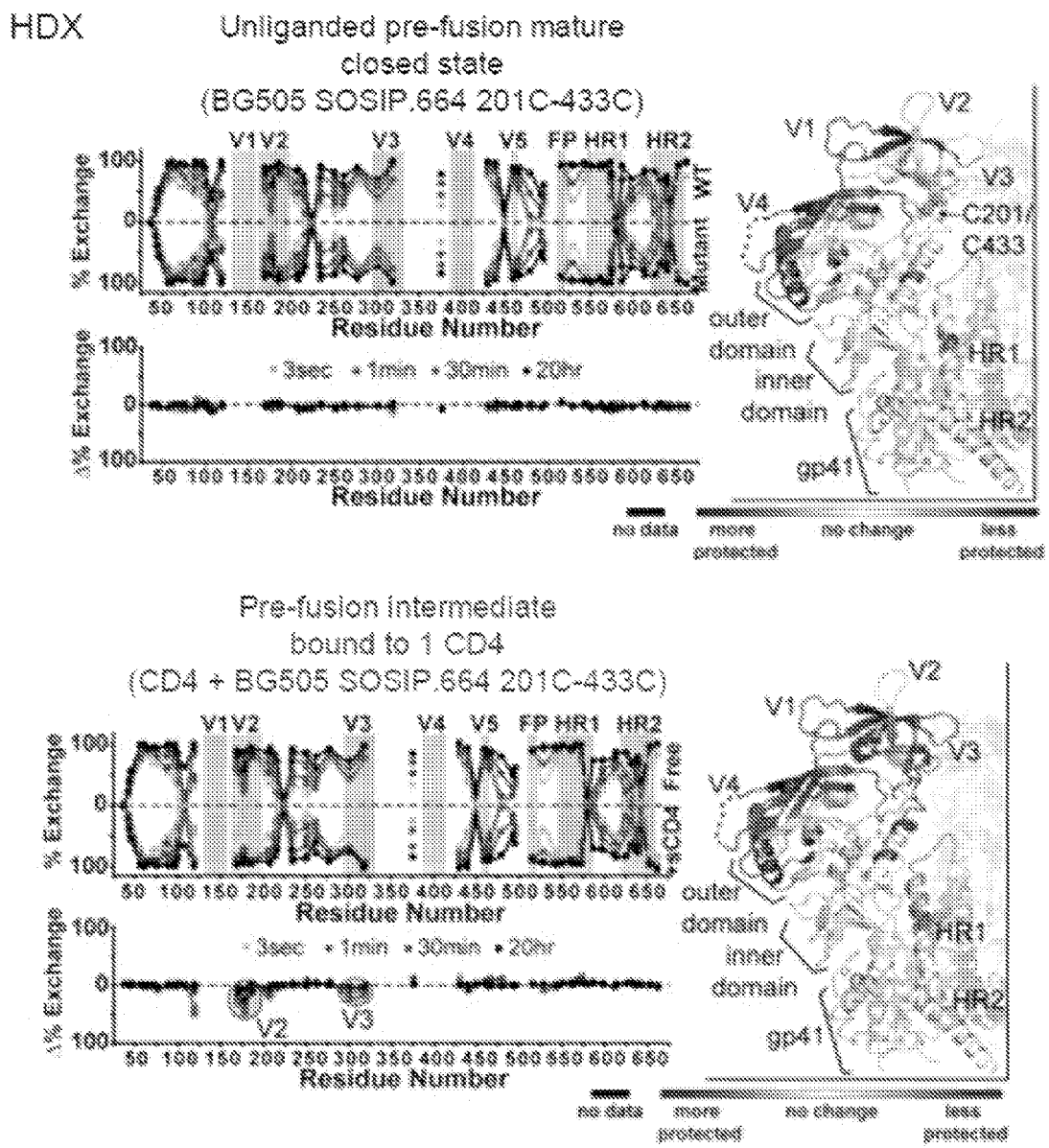
Figure 34E:
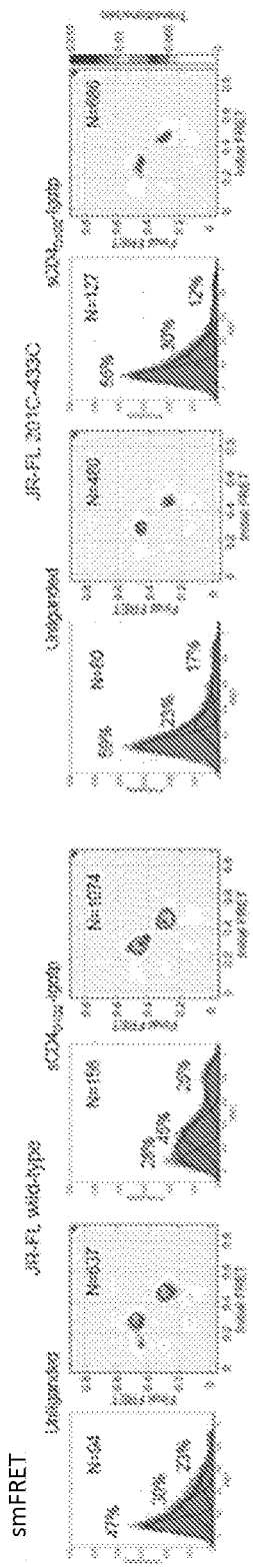
Figure 34F:
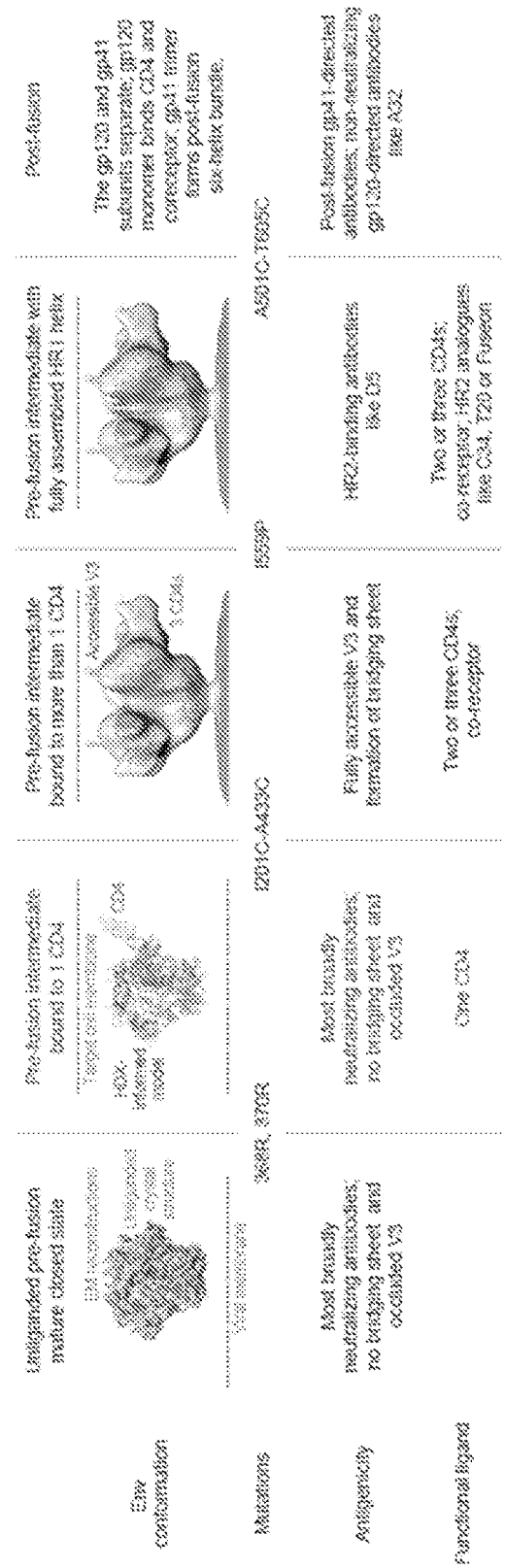

FIGS. 34A-34F are a set of diagrams and graphs illustrating that unliganded HIV-1 Env binds a single CD4 without the typical antigenic hallmarks of CD4 triggering. FIG. 34A, Binding of soluble CD4 to SOSIP.664 and mutants that stabilize the prefusion mature closed state measured by SPR (CD4 on chip). FIG. 34B, Kinetics of CD4 activation by SPR measured by binding to 17b, which recognizes a bridging sheet epitope (17b on chip; left) and to 3074, which recognizes a V3 epitope (3074 on chip; right). FIG. 34C, Sedimentation equilibrium analytical ultracentrifugation measurements of BG505 SOSIP.664 and 201C-433C variant in presence of excess soluble CD4. FIG. 34D, Butterfly plots display the HDX profiles of BG505 SOSIP.664 DS variant (left) and DS variant with CD4 (right). The percent exchange is plotted for each peptide; raw difference plots are shown below. Qualitative changes by HDX are displayed on one lobe of the unliganded trimer with regions becoming more ordered and disordered. FIG. 34E, smFRET of JR-FL virions with and without 201C-433C substitution. Population FRET histograms are each paired with transition density plots, which display the relative density of observed transitions. FIG. 34F, HIV-1 entry mechanism with conformation-blocking mutations, antigenicity, and interactions with functional ligands. The results reveal a new mechanistic state, which is characterized by the binding of a single molecule of CD4, no bridging sheet formation and reduced V3 loop exposure.

Figure 35A:
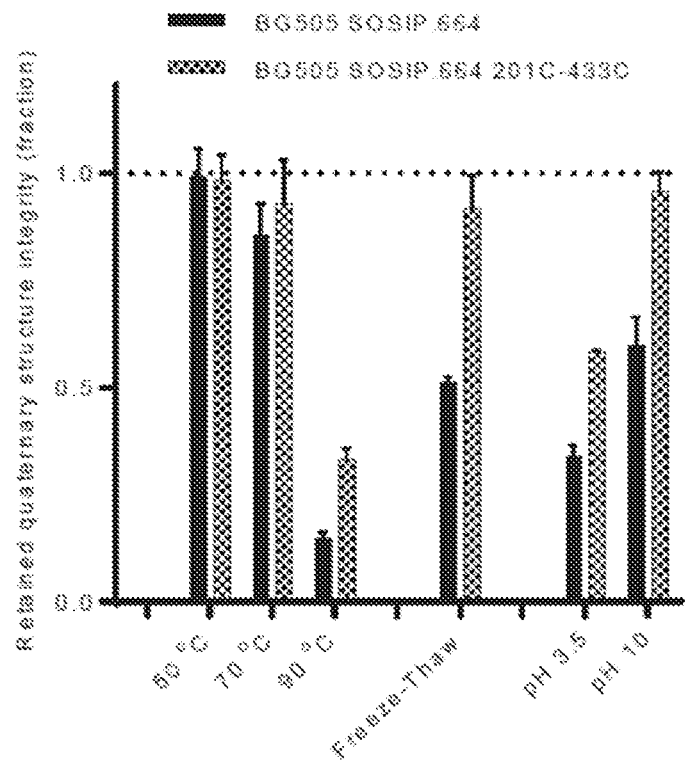

FIGS. 35A and 35B are a set of graphs illustrating properties of conformationally fixed HIV-1 Env trimeric immunogens. FIG. 35A, Physical stability of trimeric BG505 SOSIP.664 201C-433C as determined by the quaternary specific antibody VRC26.09 after 60 minutes of incubation at extremes of temperature, pH, or ten freeze-thaw cycles. FIG. 35B, Virus-like particle (VLP) antigenicity. Strain JR-FL was modified with E168K to allow binding of V1V2-directed broadly neutralizing antibodies; strain BG505 was modified with T332N to allow binding of 2G12 antibody. While broadly neutralizing antibody binding is maintained between parent and 201C-433C VLPs, the 201C-433C variant shows reduced ineffective antibody binding, especially in the presence of CD4. Ineffective antibodies labeled (CD4bs: CD4-binding site, CD4i: CD4-induced, V3: V3-loop directed)

Figure 36C:
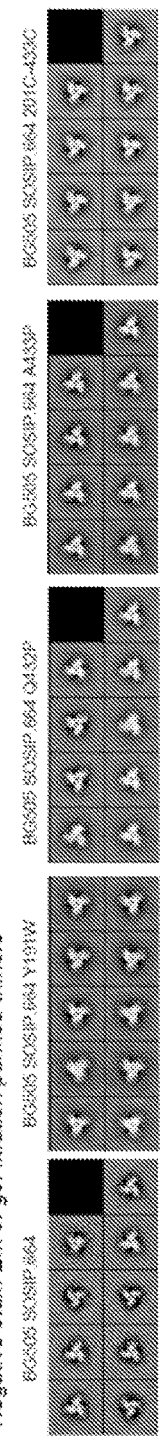
Figure 36D:
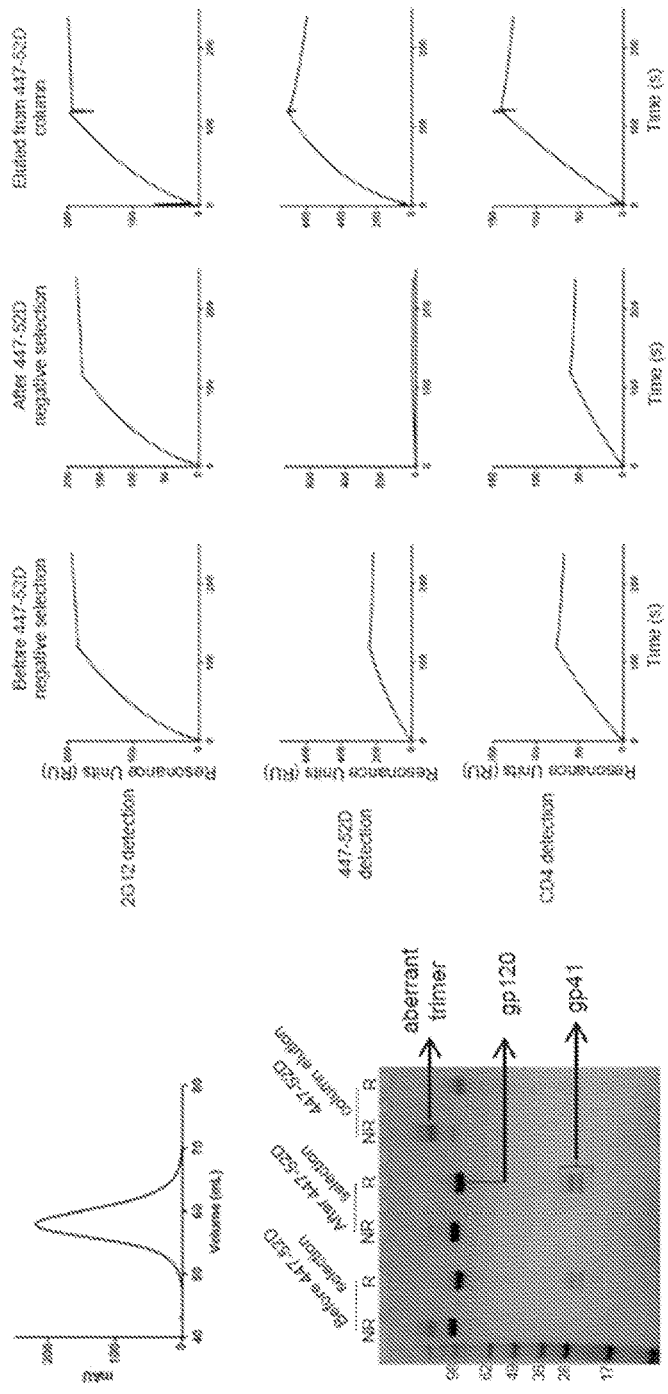

FIGS. 36A-36D are a set of graphs and tables illustrating the characterization of purified BG505 SOSIP.664 and selected variants. FIG. 36A, Properties of purified gp140 proteins. *the percentage of trimers was obtained by measuring area under the curve of the gel filtration profile of the various peaks representing aggregates, gp140 trimer, dimer and monomer. FIG. 36B, gel filtration profiles on Superdex 200 with indicated line showing a second round of purification when performed. Dotted lines show the fractions selected for analyses. FIG. 36C, 2D class averages from a reference-free classification of negative stained EM data for each protein. Box size=28 nm. FIG. 36D, 447-52D negative selection. Trimeric peak of BG505 SOSIP.664 purified over gel filtration is used as starting point. Protein is passed over a 447-52D affinity column and flow through collected as well as eluate from the 447-52D column (with 3 M MgCl2). SDS-page under reducing (R) and non-reducing conditions (NR) is shown with protein before 447-52 negative selection, protein after 447-52D negative selection and eluate from the 447-52D affinity column. A higher molecular weight band can be removed by 447-52D negative selection. SPR measurement of the same three fractions, before, after and eluate binding to 2G12, 447-52D and CD4. The portion of the protein that binds to 447-52D can be removed by negative selection while maintaining CD4 and 2G12 binding. 80% of the protein is recovered after 447-52D negative selection.

Figure 37A:
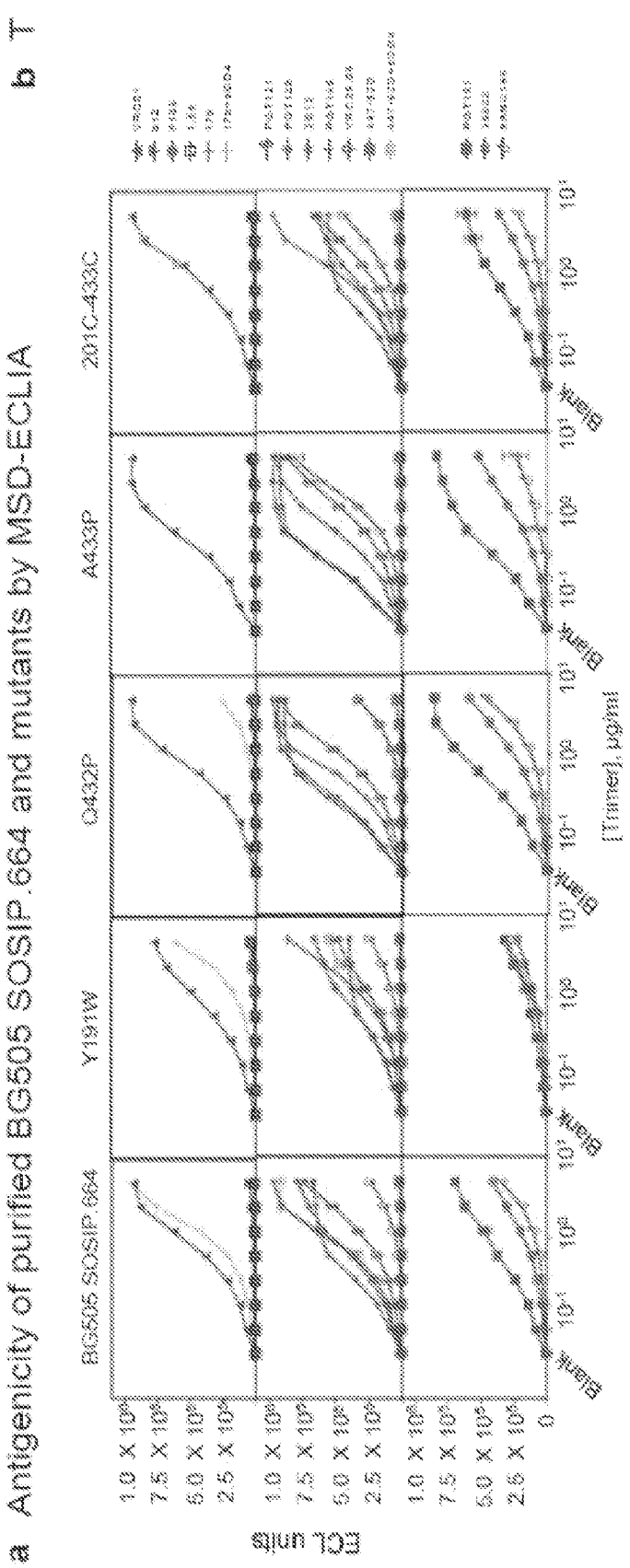
Figure 37B:
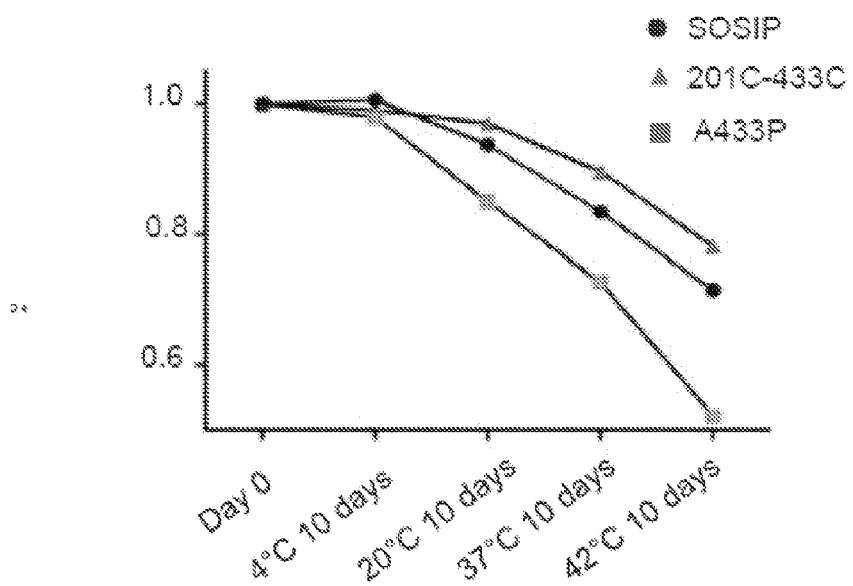
Figure 37C:
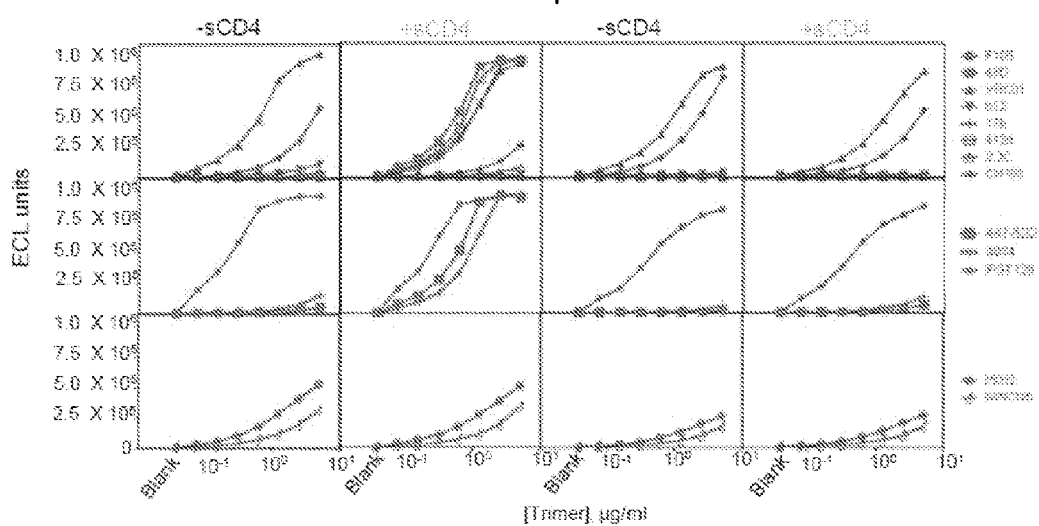
Figure 37D:
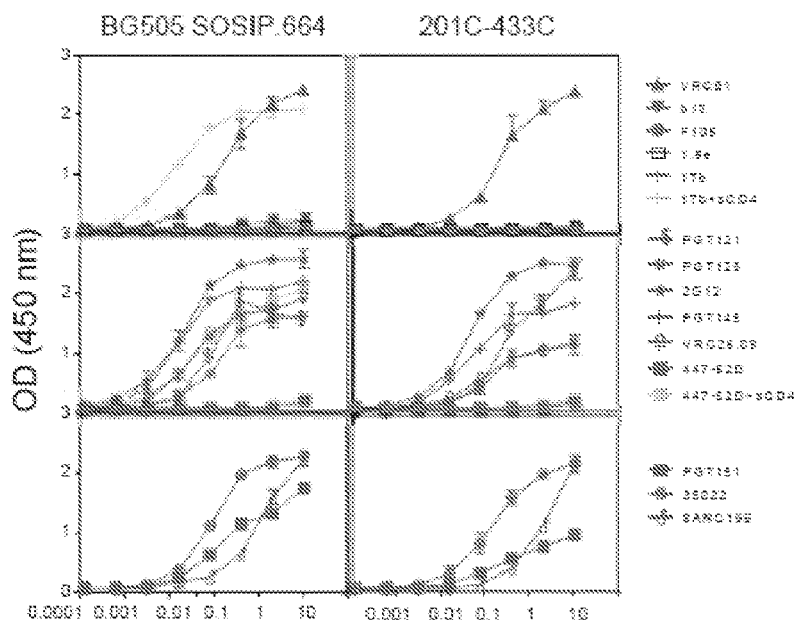
Figure 37E:
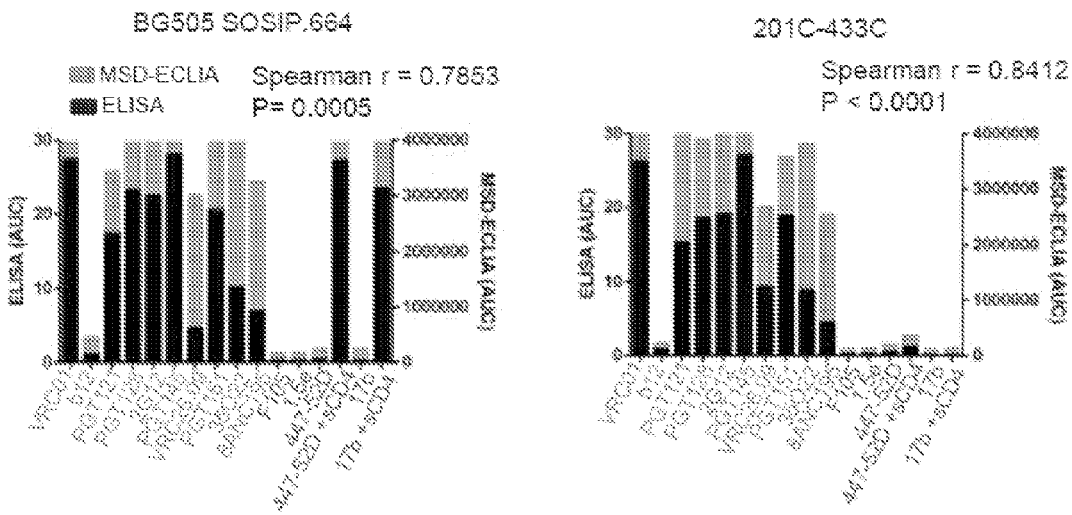

FIGS. 37A-37E are a set of graphs illustrating the antigenicity of purified BG505 SOSIP.664 and selected variants by MSD and ELISA. FIG. 37A, Antigenicity of BG505 SOSIP.664 and mutants by MSD-ECLIA. Plots show binding of neutralizing, non- or weakly neutralizing antibodies (dark grey) and antibodies in presence of CD4 to BG505 SOSIP.664 and mutants. FIG. 37B, Temporal stability of BG505 SOSIP.664, A433P and 201C-433C. FIG. 37C, Comparison of antigenicity of BG505 SOSIP.664 and 201C-433C in absence and presence of soluble, 2-domain CD4. FIG. 37D, Antigenicity of BG505 SOSIP.664 and 201C-433C assessed by ELISA. FIG. 37E, Pair wise comparison of antigenicity data obtained by MSD-ECLIA and ELISA.

Figure 38A:
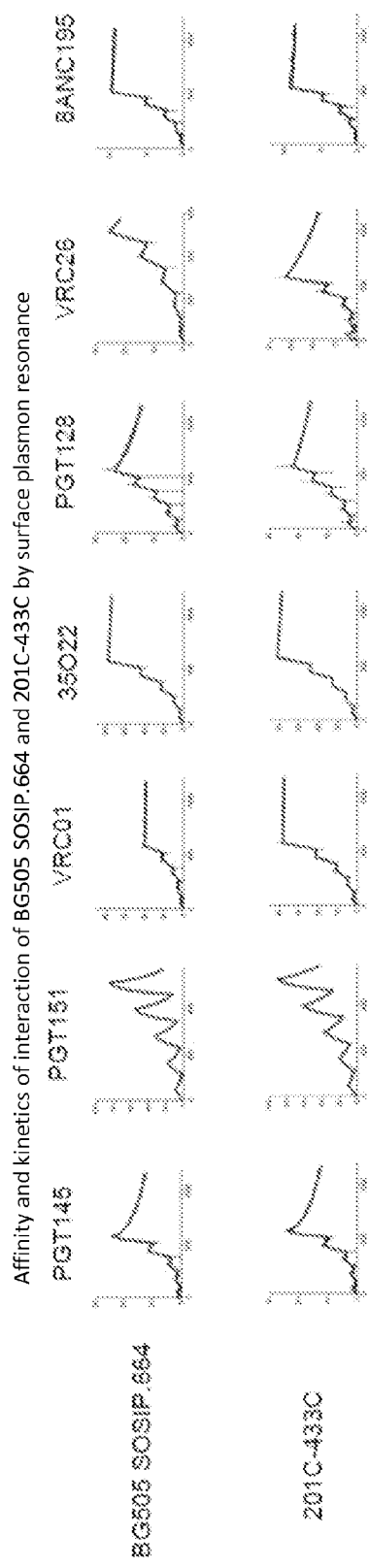
Figure 38B:
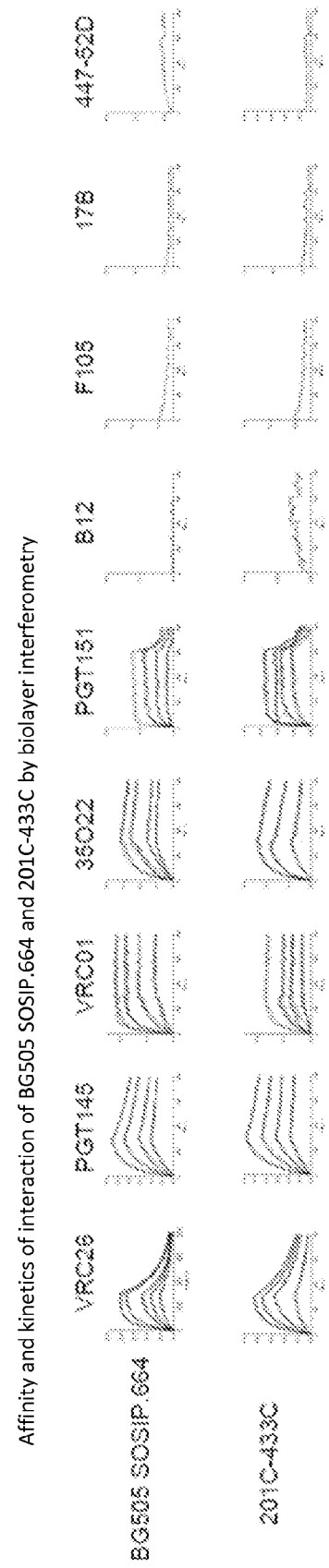

FIGS. 38A-38D are a set of graphs and tables illustrating the antigenicity of purified BG505 SOSIP.664 and 201C-433C by SPR and BLI. Binding of BG505 SOSIP.664 and 201C-433C measured by FIG. 38A, Surface Plasmon Resonance and FIG. 38B, Biolayer Interferometry. FIG. 38C, Affinities of BG505 SOSIP.664 and 201C-433C to neutralizing and non-neutralizing antibodies by SPR and Biolayer interferometry. FIG. 38D, Pairwise comparison of antigenicity data by 4 methods- MSD, ELISA, BLI and SPR. The P values were corrected for false discovery rate for multiple comparisons.

Figure 39A:
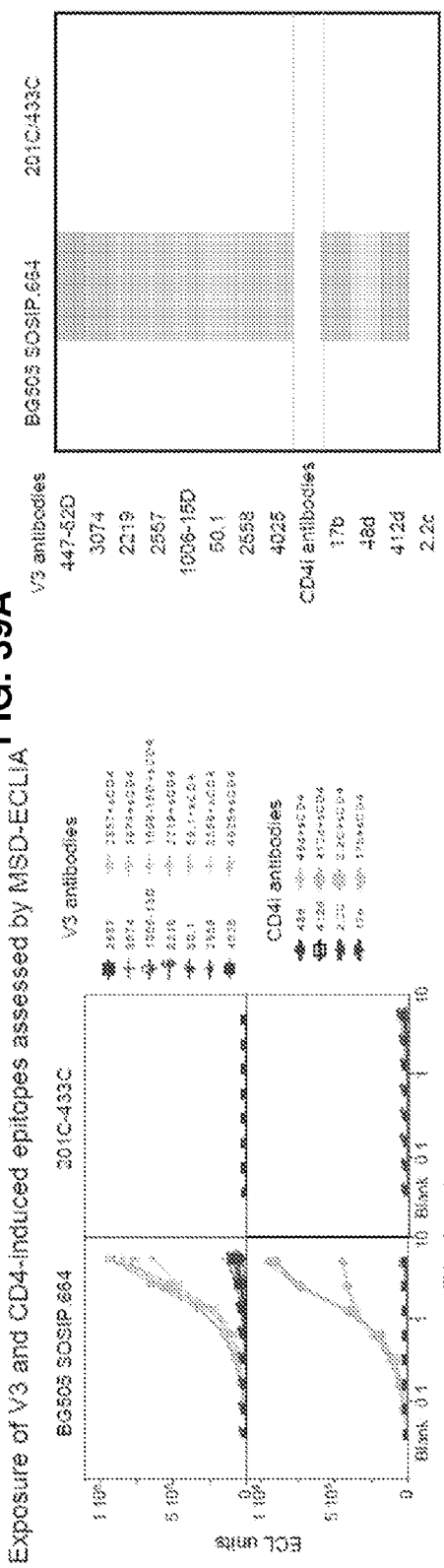
Figure 39B:
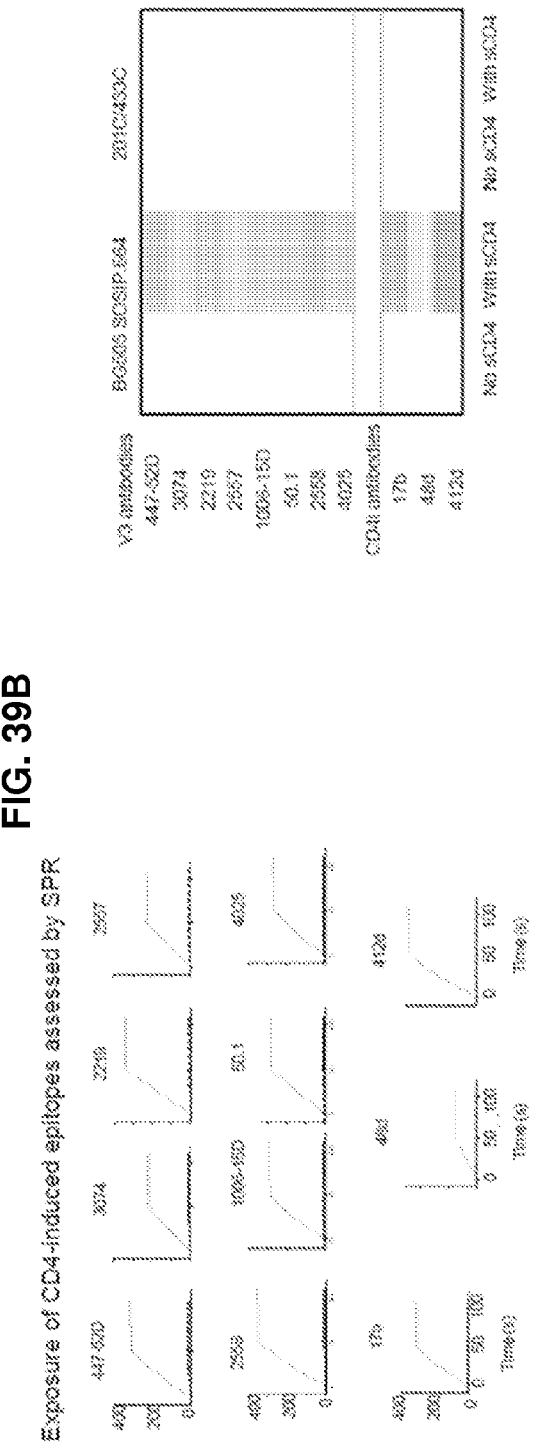
Figure 39C:
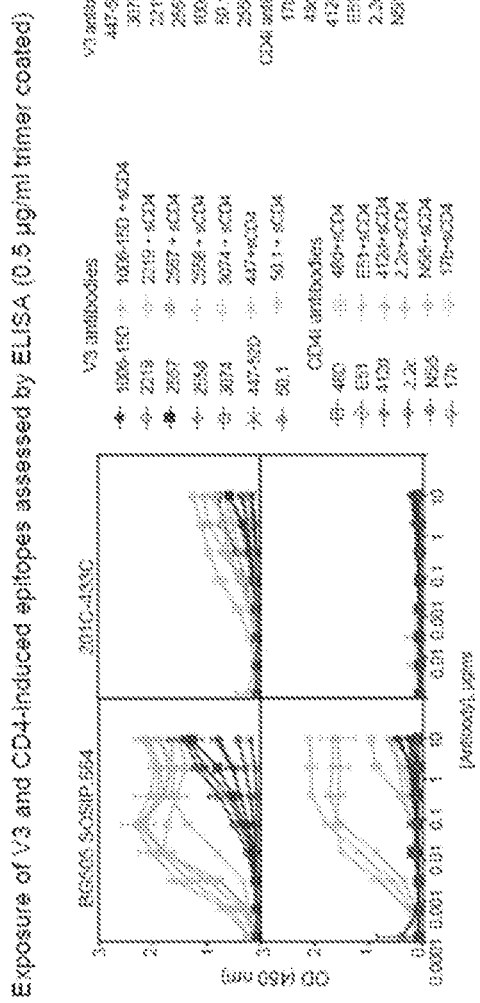
Figure 39D:
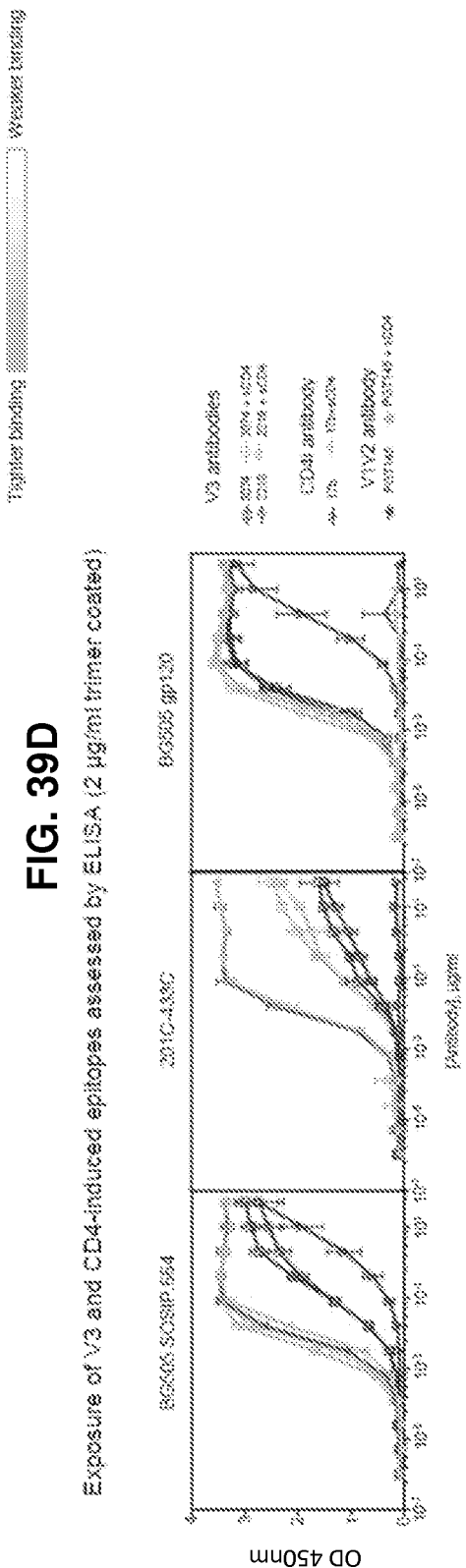

FIGS. 39A-39D are a set of graphs illustrating the characterization of BG505 SOSIP.664 and 201C-433C binding to CD4-induced epitopes in absence and presence of CD4 by FIG. 39A, MSD-ECLIA FIG. 39B, SPR with antibodies captured on an anti-Fc surface and trimer as analyte, SOSIP is shown in solid line and 201C-433C in dashed line, trimer without CD4 is dark grey and trimer with CD4 light grey. FIG. 39C and FIG. 39D, ELISA at 0.5 µg/ml and 2 µg/ml trimer captured on D7324-coated plates, respectively.

Figure 40A:
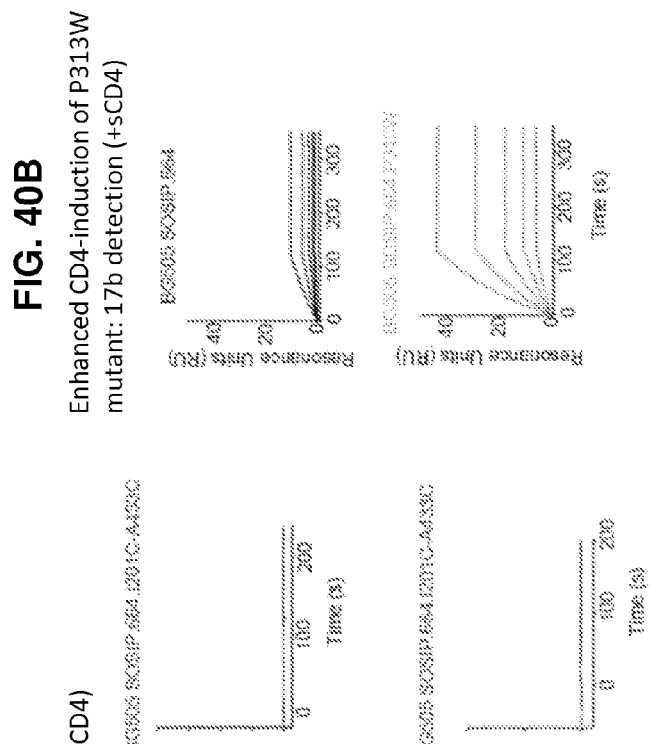
Figure 40B:
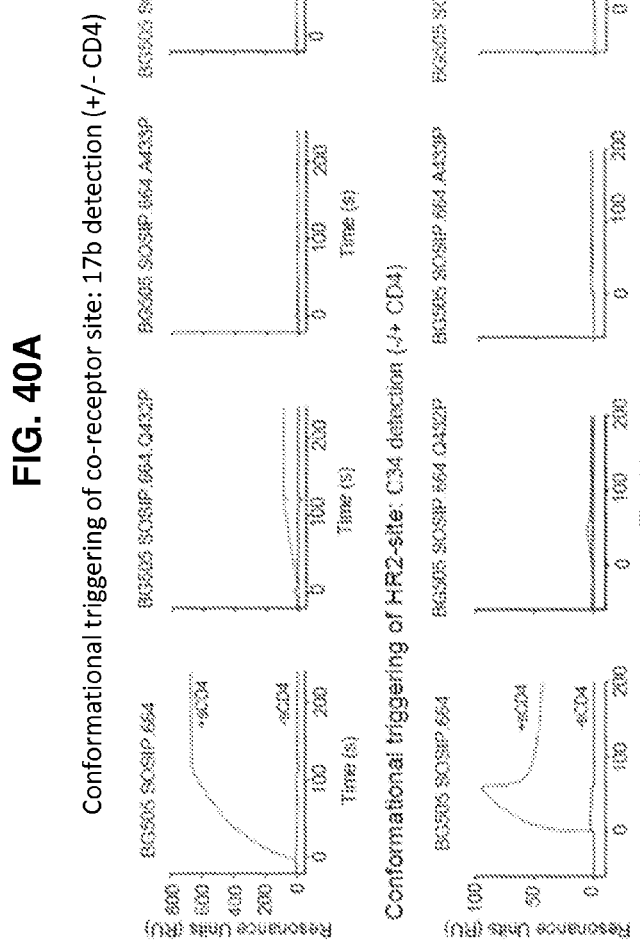

FIGS. 40A-40E are a set of graphs illustrating the CD4-induced activation of HIV-1 Env. FIG. 40A, SPR analysis of (top panel) co-receptor site exposure and (bottom panel) HR2-site exposure upon CD4 activation. FIG. 40B, CD4-induced binding of SOSIP and P313W mutant to 17b. Trimer samples at concentrations from 40 nM to 2.5 nM in 2-fold dilutions were combined with 200 nM sCD4 and injected on a 200RU 17b IgG surface. FIG. 40C, SPR single-cycle kinetics analysis of 17b Fab binding to soluble trimers activated with sCD4. Under conditions of constant 50 nM sCD4 flow, 17b Fab at was injected incrementally in 2-fold dilutions from 25 nM to 1.5 nM on trimer captured on a 2G12 chip. A433P and 201C-433C were further subjected to 17b Fab concentrations ranging from 500 nM to 31.25 nM (insets). FIG. 40D, Time-dependent increase in exposure of V3 epitope (3074 detection) and bridging sheet (17b detection) in SOSIP trimers on incubation with sCD4. FIG. 40E, Ability of HIV-1 BG505 and mutants to enter CD4+CCR5+ cells.

Figure 41:
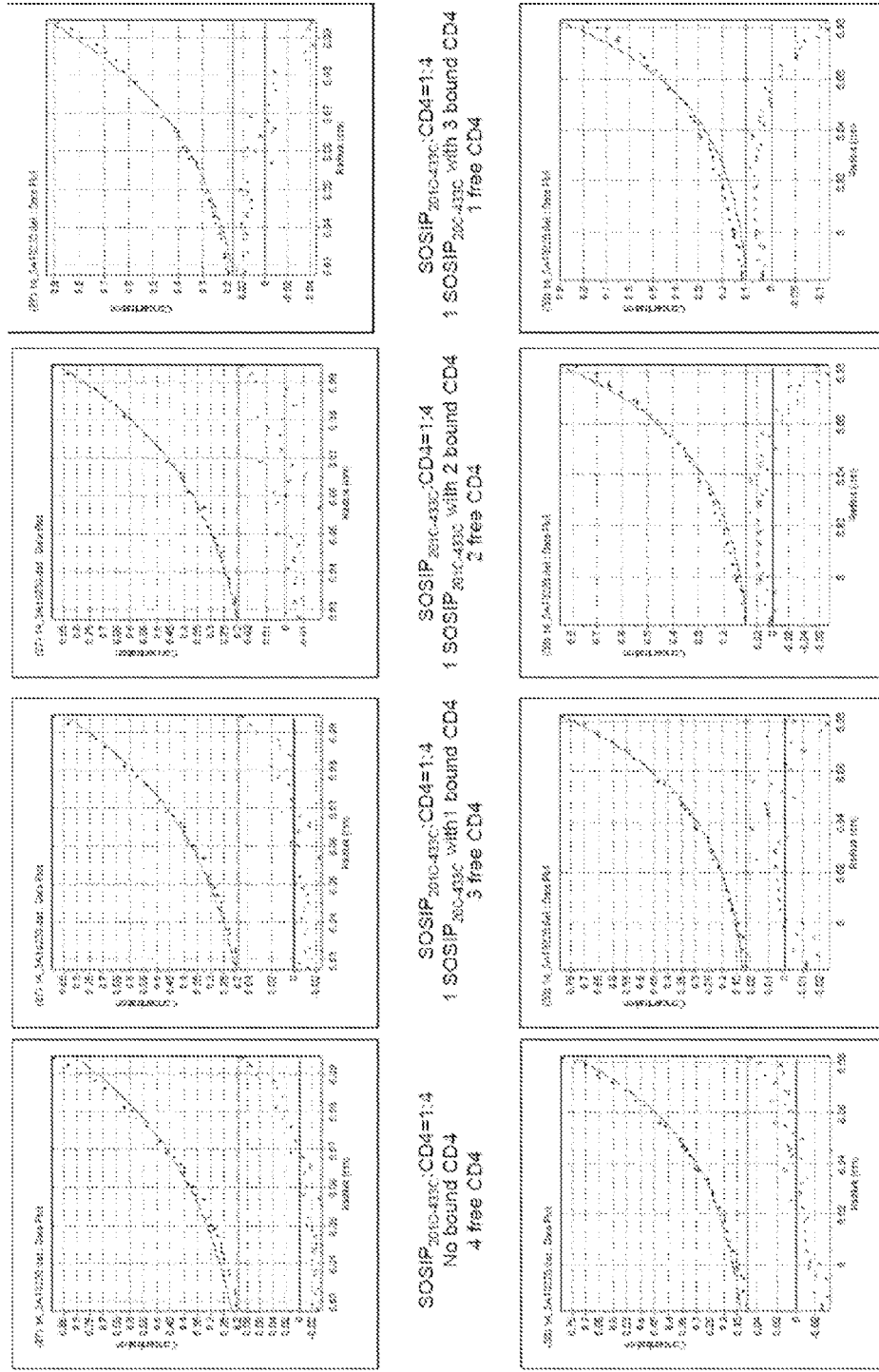

FIG. 41 is a set of graphs illustrating the analysis of stoichiometry of CD4-binding to BG505SOSIP.664.332N or the DS variant, BG505SOSIP 201C-433C. Masses were determined for each molecule by MALDI-TOF mass spectrometry, as follows: BG505.SOSIP.664 ((109,994±11 Da)×3=329,982±33 Da), BG505.SOSIP.664 201C-433C ((109,006±10 Da)×3=327,018±30 Da), and CD4 d1d2 (20,329±2 Da). For the BG505 SOSIP molecules, monomer masses were determined, but trimeric masses were used in the analytical ultracentrifugation fitting. Four fittings are shown for each experiment, with fits calculated for 0, 1, 2, or 3 bound CD4 molecules, respectively. For BG505SOSIP.664.N332, the residual errors switch direction between 1:2 and 1:3 stoichiometries, suggesting 2-3 CD4 molecules bound. For the DS mutant, BG505SOSIP 201C-433C, the residual errors fit best at 1:1 stoichiometry and fail to fit higher numbers of bound CD4 molecules, indicating 1 CD4 molecule bound per DS trimer.

FIGS. 42A-42G, 43 and 44 are a set of tables showing antigenic characteristics of recombinant HIV-1 Env ectodomain trimers (FIGS. 42A-42G, and 44), protein nanoparticles including recombinant HIV-1 Env ectodomain trimers (FIG. 43). The binding activity of the recombinant HIV-1 Env trimers or protein nanoparticles including recombinant HIV-1 Env ectodomain trimers was compared to that of the HIV-1 Env BG505 SOSIP.664 construct by ELISA assay. "+++" indicates binding within 75% of HIV-1 Env BG505 SOSIP.664, "++" indicates binding between 50-75% of HIV-1 Env BG505 SOSIP.664, "+" indicates binding within 25-50% of HIV-1 Env BG505 SOSIP.664, and "−" indicates binding within 0-25% of HIV-1 Env BG505 SOSIP.664.

Figure 45:
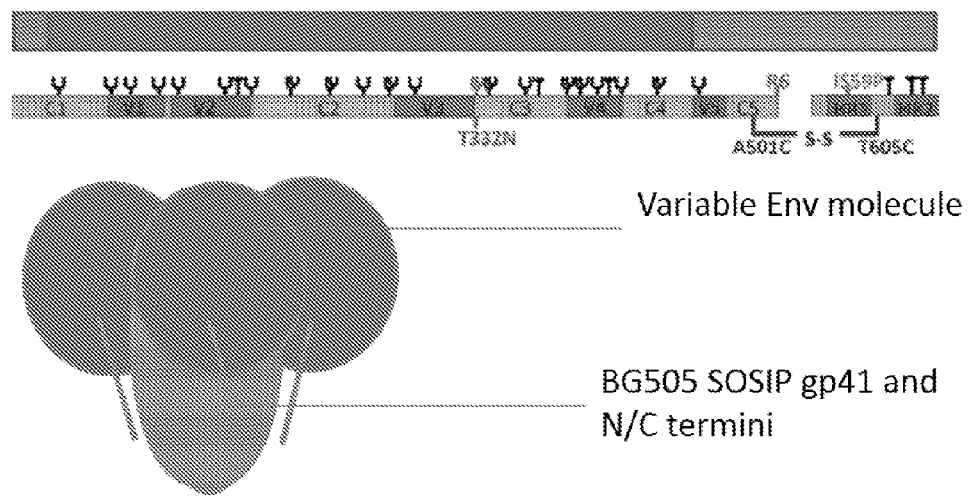
Figure 46:
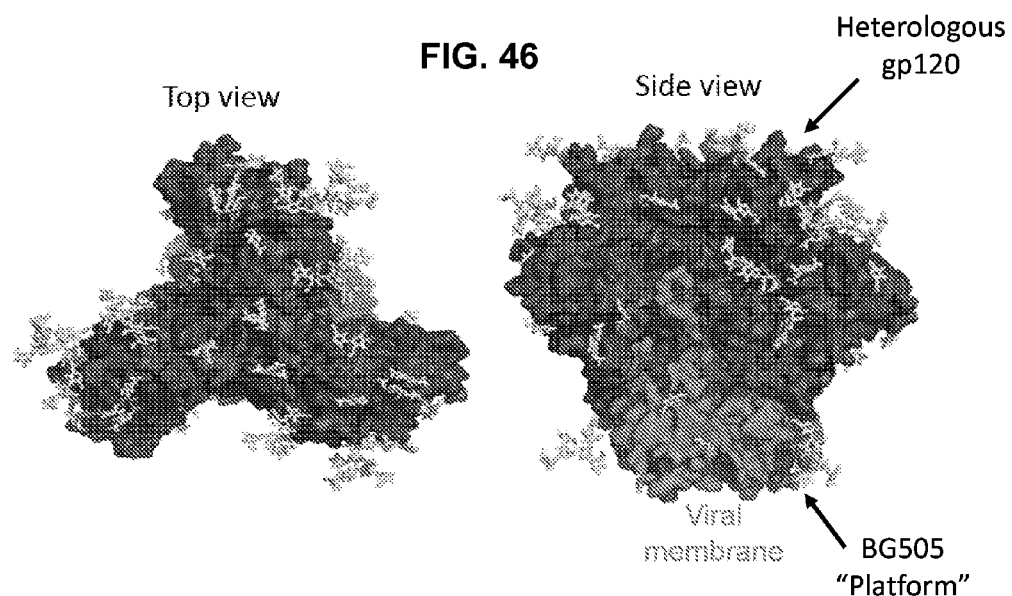

FIGS. 45 and 46 are schematic diagrams illustrating the construction of chimeric HIV-1 Env ectodomain trimers including gp120 N- and C-terminal sequences from a first HIV-1 strain (shown in lighter grey) with the remainder of gp120 from a second HIV-1 strain (shown in darker grey).

Figure 47:
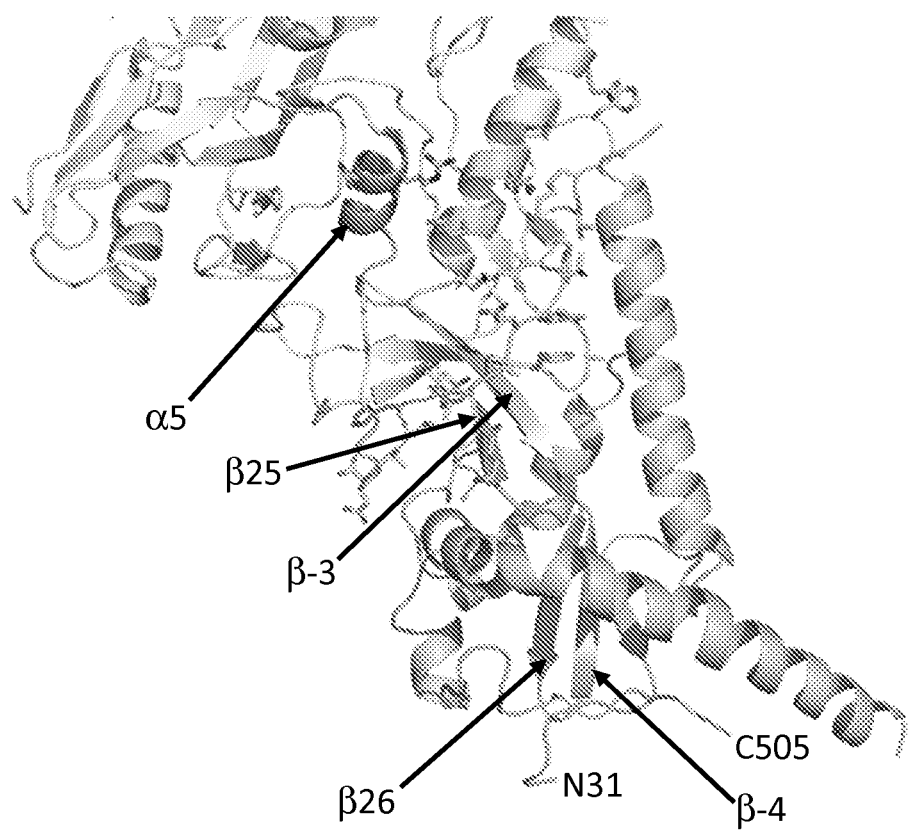

FIG. 47 is a ribbon diagram showing a single protomer of the HIV-1 Env ectodomain in a mature prefusion closed conformation, with certain structural elements and residues indicated. The β-4 and β-3 strands at the N-terminal region of gp120 and the β26 and β25 strands and α5 helix at the C-terminal region of gp120 indicated. Many of the residues of gp120 that interface with gp41 (residues 46-54, 70-75, 84-89, 99, 102, 106, 107, 114, 215, 220-224, 226, 244, 471-473, 476-477) are present.

Figure 48:
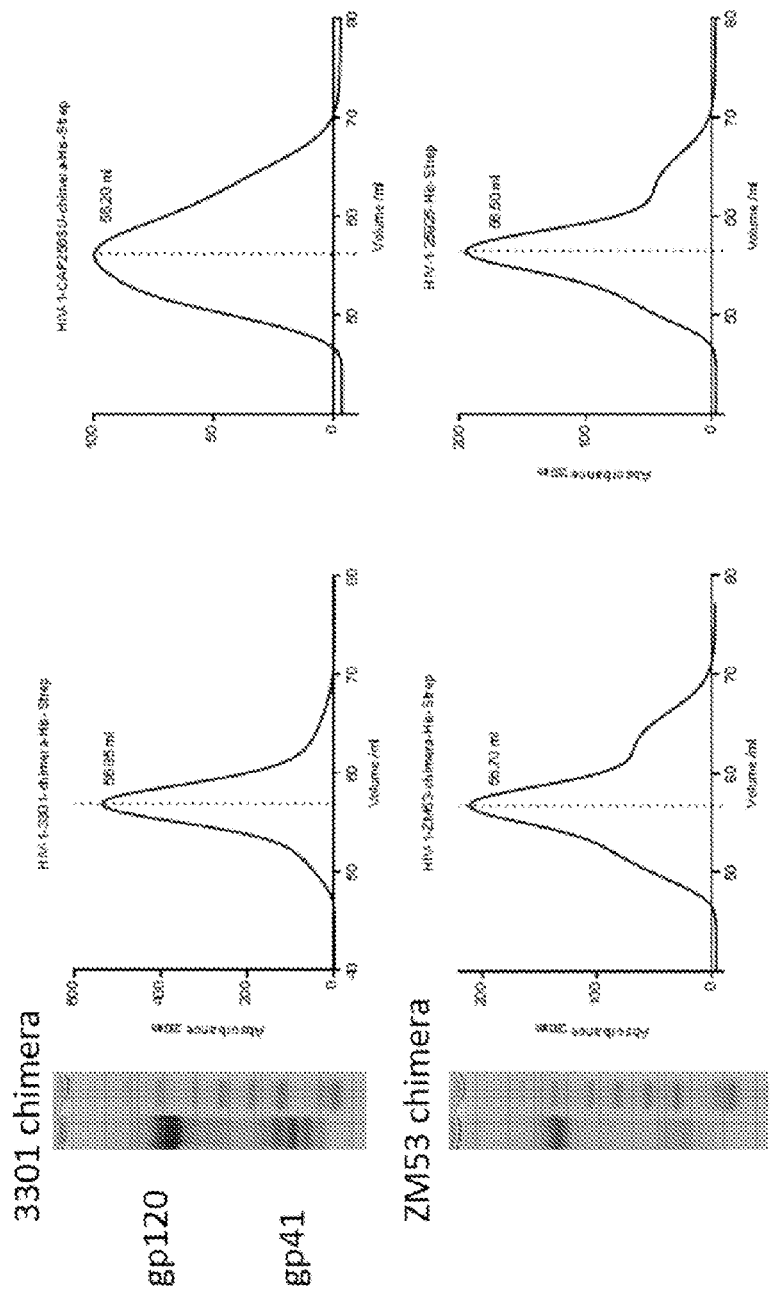

FIG. 48 shows a set of coommassie stained SDS-PAGE gels and elution profile graphs illustrating purification chimeric HIV-1 Env ectodomain trimers including sequences of the BG505 HIV-1 strain and one of the 3301, ZM53, CAP256-SU, and 25925 HIV-1 strains.

Figure 49:
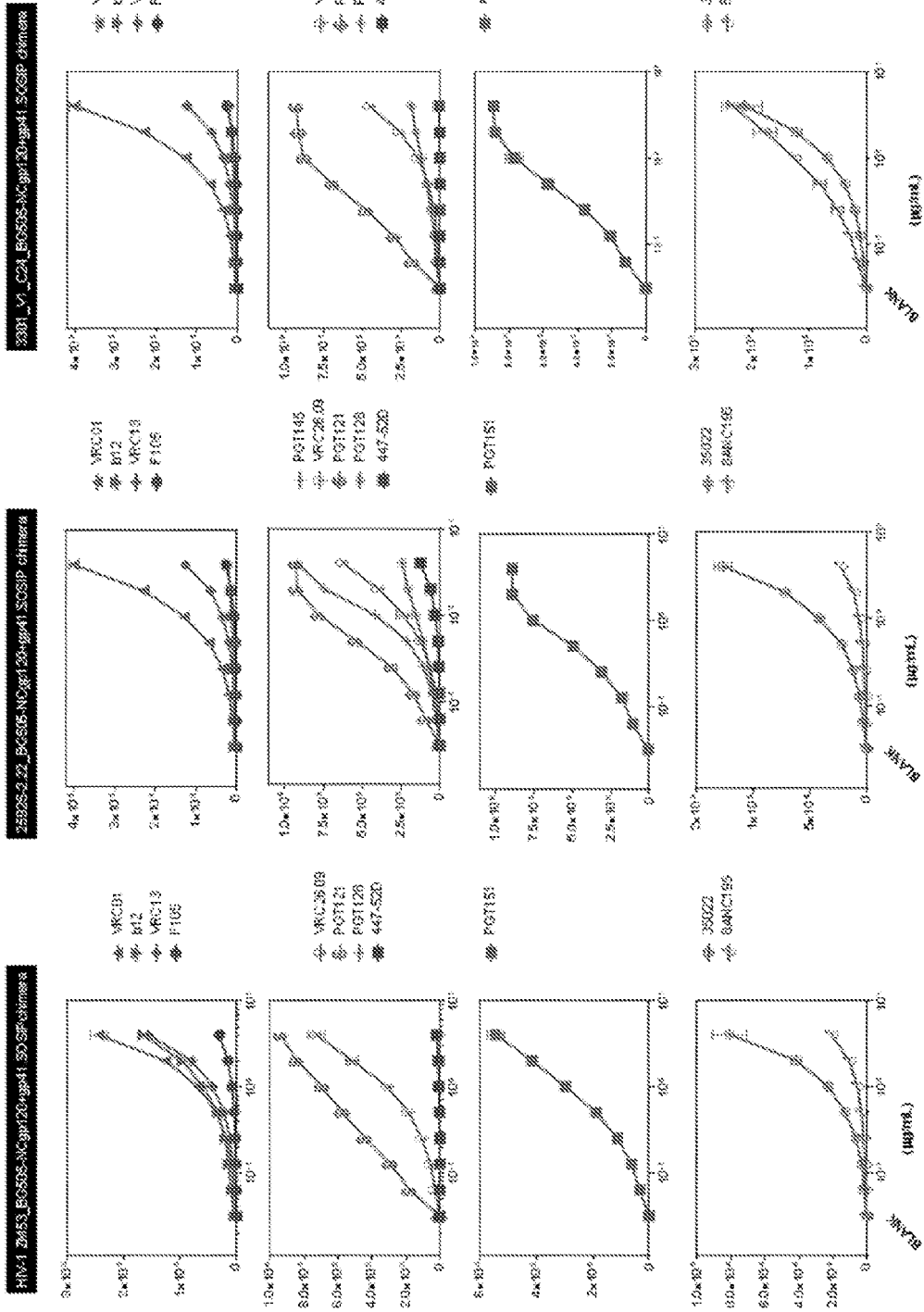

FIG. 49 is a set of graphs illustrating the antigenicity of chimeric HIV-1 Env trimers including the ZM53_BG505-NCgp120_gp41.SOSIP (SEQ ID NO: 386), 25925-2.22_BG505-NCgp120_gp41.SOSIP (SEQ ID NO: 383), and 3301_V1_C24_BG505-NCgp120+gp41.SOSIP (SEQ ID NO: 384) constructs.

FIG. 50 shows a coommassie blue stained polyacrylamide gel and a graph illustrating expression, purification, and antigenicity of a chimeric HIV-1 Env trimers including a gp120 sequence from the BG505 strain, a gp41 sequence from the CAP45 strain, and the SOSIP mutations (SEQ ID NO: 772).

Figure 51:
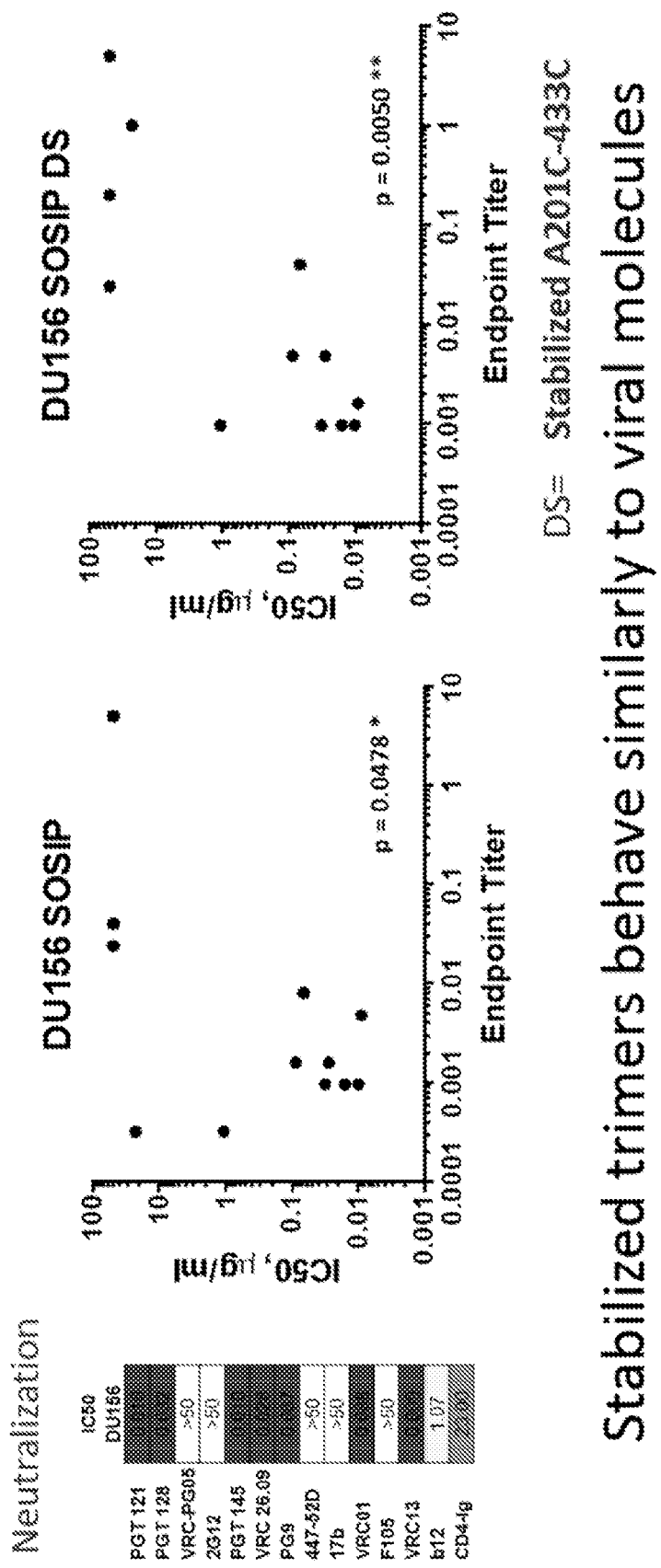

FIG. 51 is a set of graphs illustrating that the neutralization profile of the indicated antibodies for the native DU156 virus correlates with the antigenic profile of a recombinant HIV-1 Env ectodomain trimer stabilized in the prefusion mature closed conformation as disclosed herein.

FIG. 52 shows a set of electron micrograph images indicating that purified CNE58-strandC, CAP256-SU, and 3301_V1_C24_bg505 chimeric HIV-1 Env ectodomains attain trimeric closed configuration.

FIGS. 53A-53E are a set of tables illustrating the antigenic characteristics of the indicated recombinant HIV-1 Env ectodomain trimers. A "1" following the name of recombinant Env ectodomain indicates that the assayed HIV-1 Env ectodomain is a chimeric HIV-1 Env ectodomain including gp120 residues 31-45 and 478-507, and gp41 residues 512-664 from the BG505 strain with SOSIP substitutions, and a disulfide between residues 201-433, with the remainder of the gp120 sequence from a second HIV-1 strain. A "2" following the name of recombinant Env ectodomain indicates that the assayed HIV-1 Env ectodomain is a chimeric HIV-1 Env ectodomain including gp120 residues 31-45, 478-507, and Interface Residue Set A (see Example 5), and gp41 residues 512-664 from the BG505 strain with SOSIP substitutions, and a disulfide between residues 201-433, with the remainder of the gp120 sequence from a second HIV-1 strain. A "3" following the name of recombinant Env ectodomain indicates that assayed HIV-1 Env ectodomain is a chimeric single chain HIV-1 Env ectodomain including gp120 residues 31-45 and 478-507, and gp41 residues 512-664 from the BG505 strain with SOSIP substitutions, and a disulfide between residues 201-433, with the remainder of the gp120 sequence from a second HIV-1 strain, and peptide linker in place of the protease cleavage site between gp120 and gp41. A "4" following the name of recombinant Env ectodomain indicates that the assayed HIV-1 Env ectodomain includes the SOSIP substitutions is a chimeric protein including gp120 residues 31-34 from the BG505 strain with SOSIP substitutions, and a disulfide between residues 201-433, with the remainder of the gp120 and gp41 sequences from a second HIV-1 strain.

FIGS. 54A and 54B are a set of graphs illustrating results from ELISA assays showing that the BG505.SOSIP.664.201C-433C HIV-1 Env ectodomain trimer induces production of HIV-1 Env trimer specific and V3-peptide specific antibodies in rabbits (FIG. 54A) and guinea pigs (FIG. 54B).

Figure 55A:
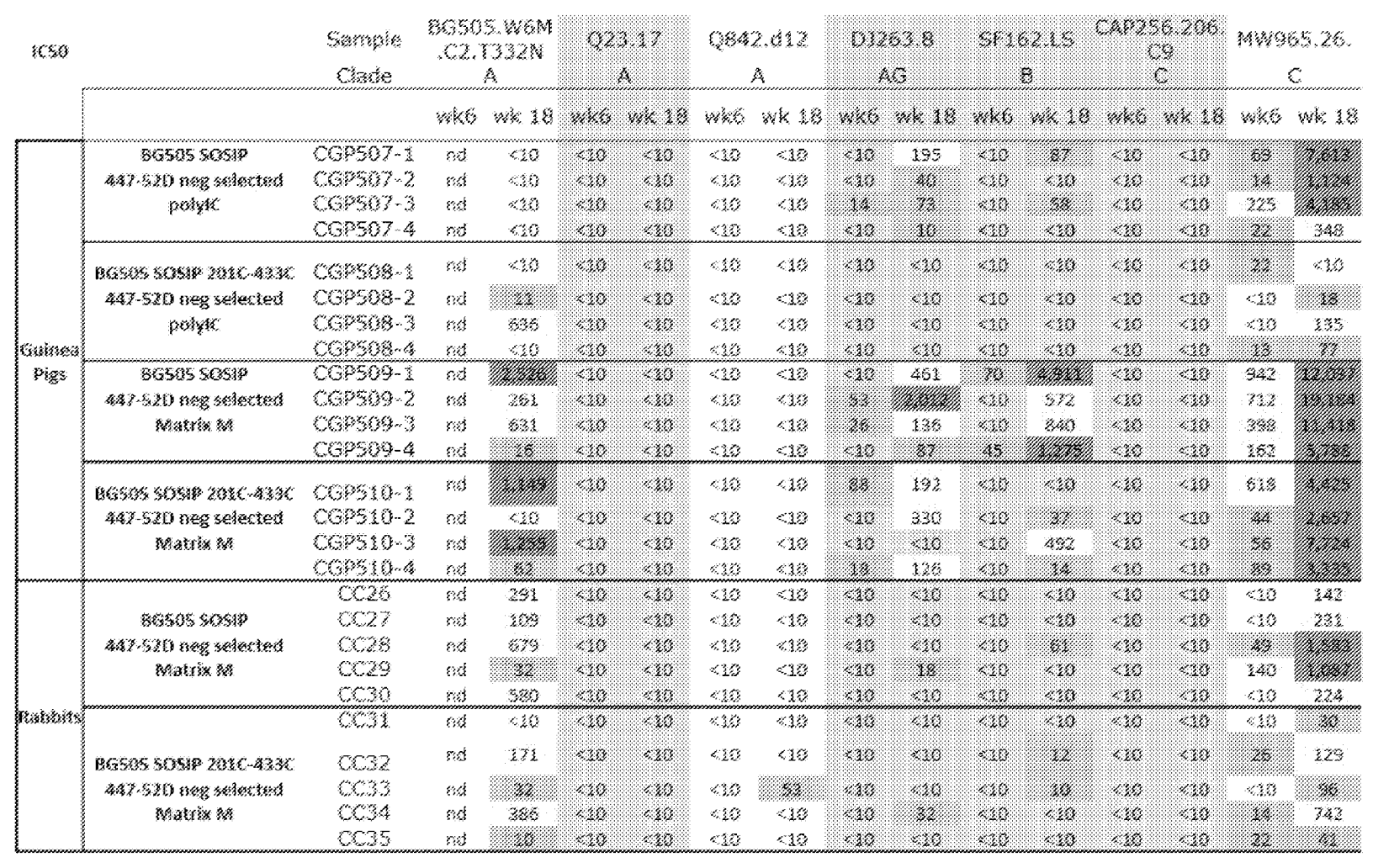

FIGS. 55A-55C are a table and a set of graphs showing results from HIV-1 neutralization assays using sera collected from rabbits or guinea pigs immunized with the BG505.SOSIP.664 HIV-1 Env ectodomain trimer or the BG505.SOSIP.664.201C-433C "DS" HIV-1 Env ectodomain trimer. Each immunogen elicited comparable autologous virus (BG505.W6M.C2.T332N) and V3 directed tier 1 virus (MW965.26) neutralizing activity as measured by $IC_{50}$. A summary of the results for autologous virus and V3 directed tier 1 virus is provided for guinea pig week 18 sera (FIG. 55B) and rabbit week 18 sera (FIG. 55C).

FIG. 56 is a table listing antigenic characteristics of chimeric HIV-1 Env ectodomains linked to a transmembrane domain as expressed on surface of cells.

Figure 57:
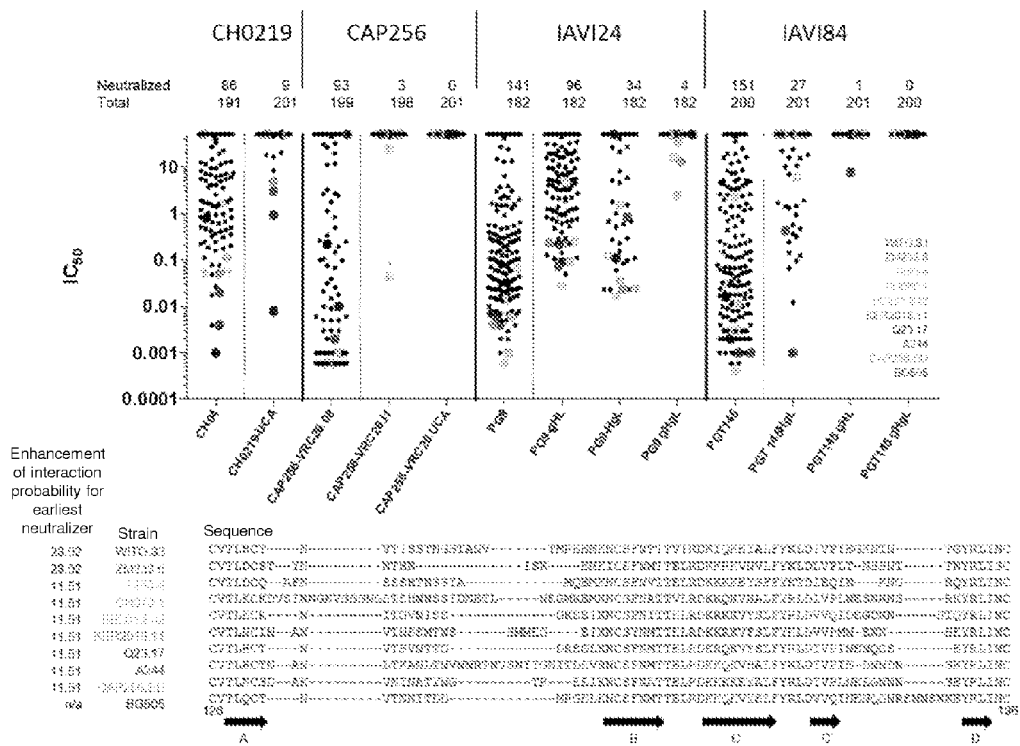

FIG. 57 is a graph and a sequence alignment showing that the inferred ancestor and intermediates of V1V2-directed bNAbs neutralize a common set of HIV-1 isolates. "Neutralized" represents the number of HIV-1 strains with $IC_{50}$ of less than 50 µg/ml, and "Total" indicates the number of HIV-1 strains tested; $IC_{50}$ for select strains is indicated by a colored dot. Nomenclature of the revertants is as follows: unmutated common ancestor (UCA), reverted V-gene, mature CDR3 (gHgL), early intermediate from next-generation sequencing (I1). The sequence of the V1V2 domain (positions 129-196) of the BG505 (SEQ ID NO: 2), CAP256.SU (SEQ ID NO: 51), BB201.B42 (SEQ ID NO: 81), KER2018.11 (SEQ ID NO: 107), CH070.1 (SEQ ID NO: 174), ZM233.6 (SEQ ID NO: 745), Q23.17 (SEQ ID NO: 746), A244 (SEQ ID NO: 747), T250-4 (SEQ ID NO: 2114), and WITO.33 (SEQ ID NO: 748) strains of HIV-1 is shown.

Figure 58A:
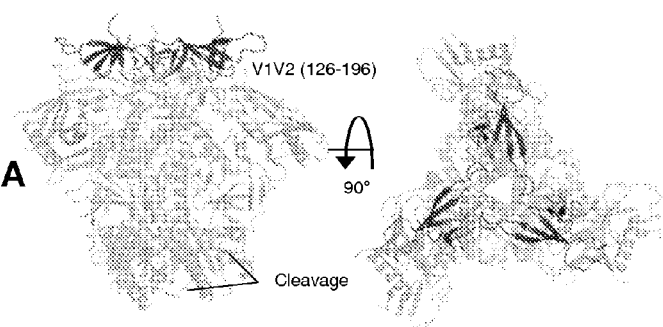
Figure 58B:
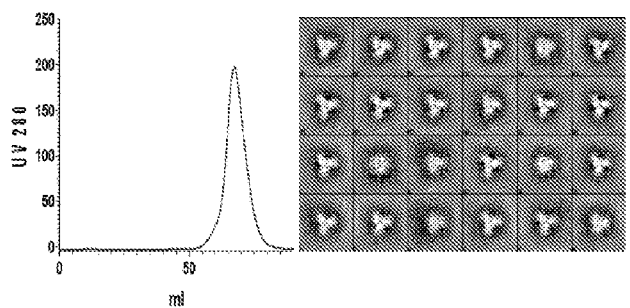
Figure 58C:
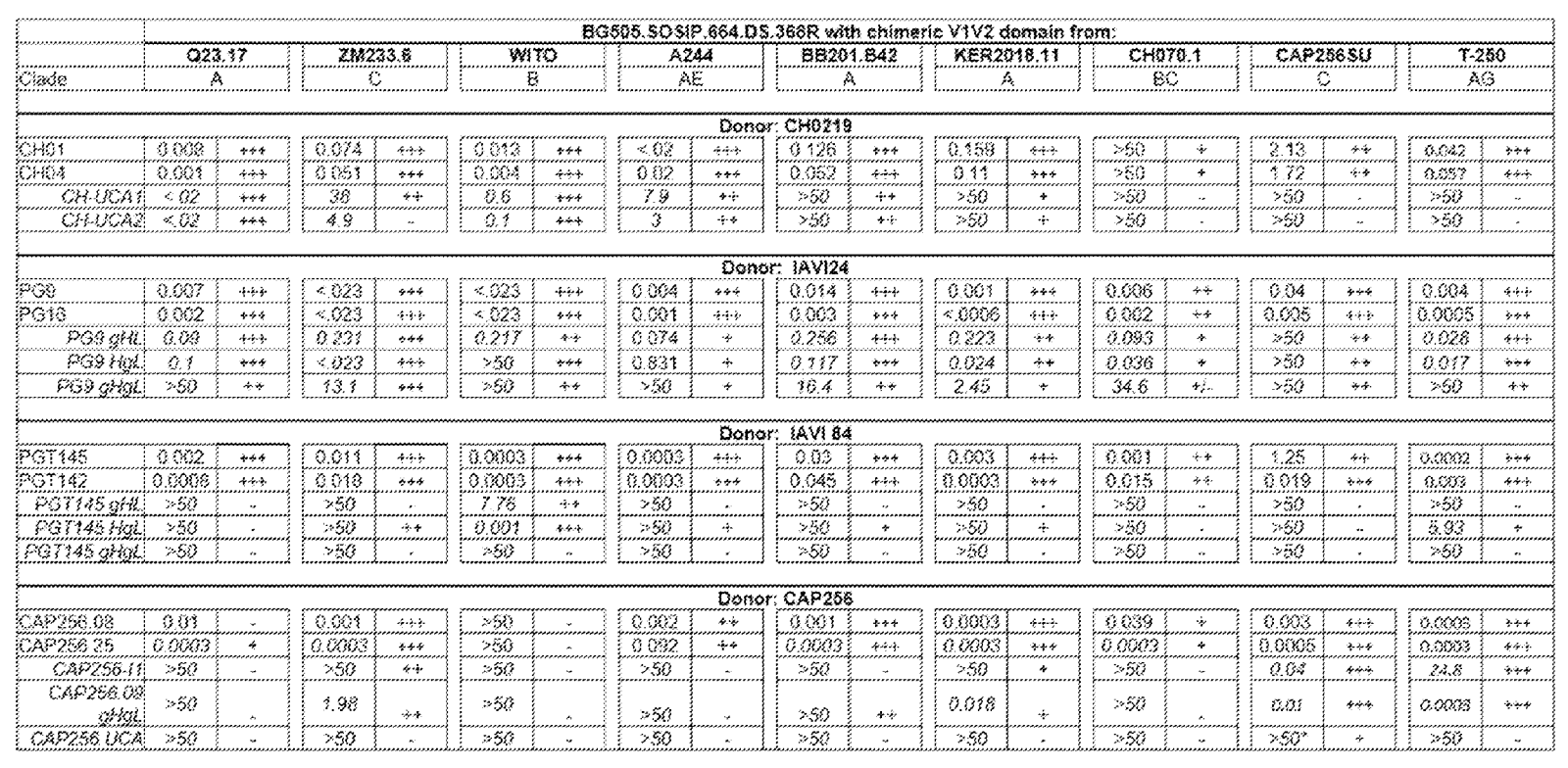

FIGS. 58A-58C illustrate the design and antigenicity of HIV-1 Env ectodomain trimer immunogens stabilized in the prefusion mature closed conformation that include a chimeric V1V2 domain sequence. (FIG. 58A) Design of chimeric V1V2 DS-SOSIP.664 trimers. Residues 126-196 of strains found to preferentially interact with germline-reverted V1V2-directed antibodies were transferred to the corresponding region of BG505 DS-SOSIP.664, with D368R mutation. (FIG. 58B) Gel filtration and negative stain EM (2D class averages) of BG505 SOSIP.664.DS.368R.CAP256-SU, a representative chimera. (FIG. 58C) Binding of chimeric DS-SOSIP.664s and neutralization of corresponding pseudoviruses by ancestors, intermediates, and mature V1V2-directed bNAbs. Antibodies are listed in the left column, and HIV-1 strains are listed across the top; results are tabulated in double cells, with the left cell showing binding and the right cell showing neutralization. Immunogens contain the 201C-433C disulfide mutation for stabilization and also contain a D368R CD4 binding site knock out mutation to prevent the trimer from opening in vivo.

FIG. 59 is a table illustrating the antigenic characteristics of the indicated recombinant HIV-1 Env ectodomain trimers, which are chimeric HIV-1 Env ectodomain stabilized in the prefusion mature closed conformation and include BG505 and JRFL sequences.

FIG. 60 is a set of graphs showing binding to VRC20gHgL and VRC01 gHgL unmutated common ancestor (UCA) antibodies, as well as the indicated neutralizing antibodies by a chimeric HIV-1 Env ectodomain trimer including a BG505 "platform" and 426c gp120 residues with mutation of the glycan sequons at positions 276, 460 and 463 and the "DS" substitutions (201C/433C).

SEQUENCES

The nucleic and amino acid sequences are shown using standard letter abbreviations for nucleotide bases, and amino acids, as defined in 37 C.F.R. 1.822. Only one strand of each nucleic acid sequence is shown, but the complementary strand is understood as included by any reference to the displayed strand. The Sequence Listing is submitted as an ASCII text file in the form of the file named "Sequence.txt" (~11 MB), which was created on Apr. 18, 2017, which is incorporated by reference herein.

Table 13 in Example 15 provides a list of sequences and additional information concerning the sequences.

Structural Coordinates

The atomic coordinates of an asymmetric unit of the crystal structure of a trimeric HIV-1 Env ectodomain (BG505.SOSIP.664) bound to PGT122 and 35O22 Fabs in the prefusion mature closed conformation (as described in Example 1) are recited in Table 1 submitted as an ASCII text named "Table_1.txt" (~2 MB, created on Aug. 7, 2014) in U.S. Provisional Application No. 62/046,059, filed Sep. 4, 2014, and have been deposited with the Protein Data Bank as Acc. No. 4TVP. Table 1 submitted in U.S. Provisional Application No. 62/046,059, and Protein Data Bank Acc. No. 4TVP, are incorporated by reference herein.

The atomic coordinates of the crystal structure of an HIV-1 Env ectodomain trimer provided in Table 1, without the PGT122 and 35O22 Fabs, are recited in Table 2 submitted as an ASCII text named "Table_2.txt" (~2 MB, created on Aug. 7, 2014) in U.S. Provisional Application No. 62/046,059, filed Sep. 4, 2014. Table 2 provided in U.S. Provisional Application No. 62/046,059 is incorporated by reference herein.

The atomic coordinates of an asymmetric unit of the crystal structure of an unliganded trimeric HIV-1 Env ectodomain in the prefusion mature closed conformation (as described in Example 2) are recited in Table 3 submitted as an ASCII text named "Table_3.txt" (~0.7 MB, created on Aug. 7, 2014) in U.S. Provisional Application No. 62/046, 059, filed Sep. 4, 2014, and have been deposited with the Protein Data Bank as Acc. No. 47MJ. Table 3 submitted in U.S. Provisional Application No. 62/046,059, and Protein Data Bank Acc. No. 47MJ, are incorporated by reference herein.

The atomic coordinates of the crystal structure of an unliganded trimeric HIV-1 Env ectodomain in the prefusion mature closed conformation (as described in Example 2) are recited in Table 4 submitted as an ASCII text named "Table_4.txt" (~2 MB, created on Aug. 7, 2014) in U.S. Provisional Application No. 62/046,059, filed Sep. 4, 2014. Table 4 provided in U.S. Provisional Application No. 62/046,059 is incorporated by reference herein.

DETAILED DESCRIPTION

Figure 2A:
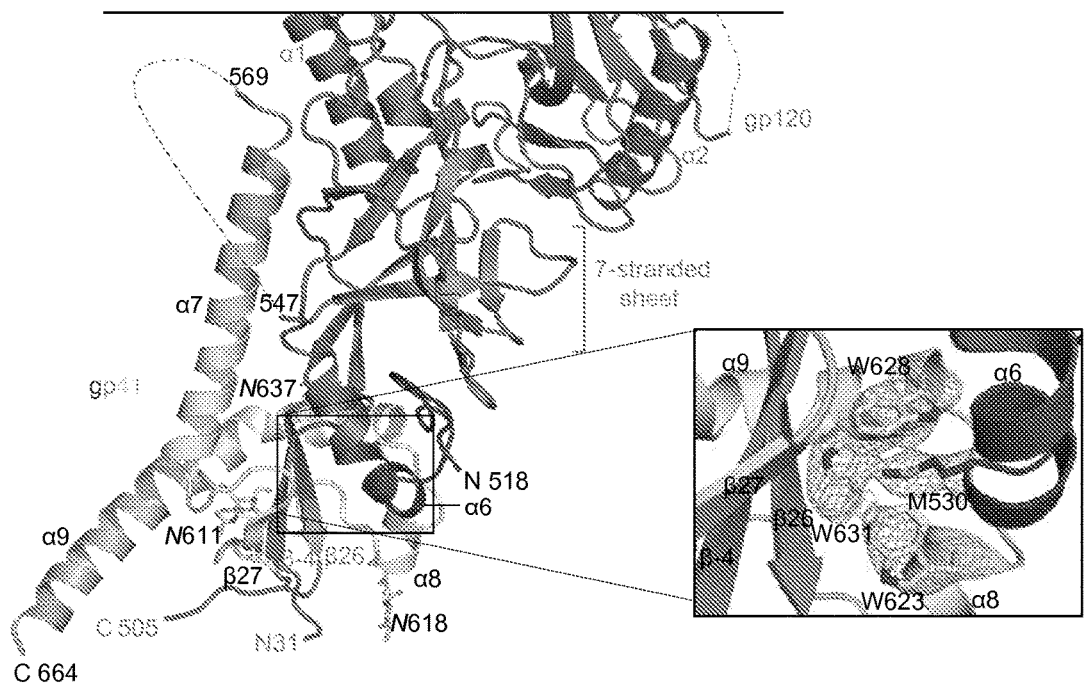
FIGS. 2A-2C illustrate the prefusion structure of gp41.
Figure 2B:
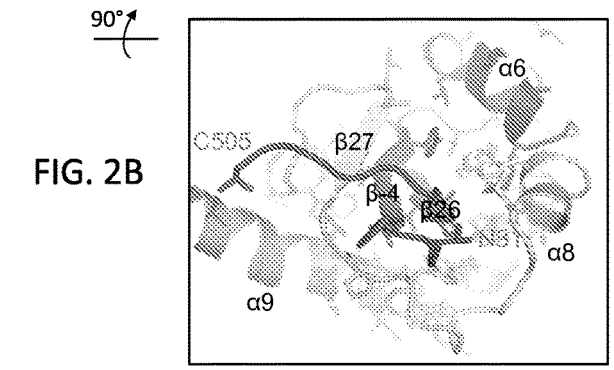
Figure 2C:
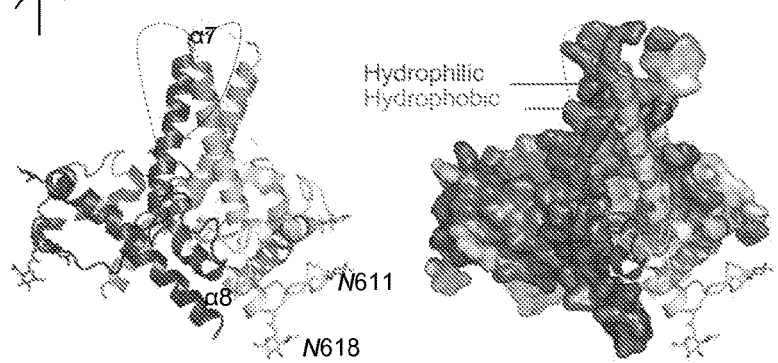
Figure 3D:
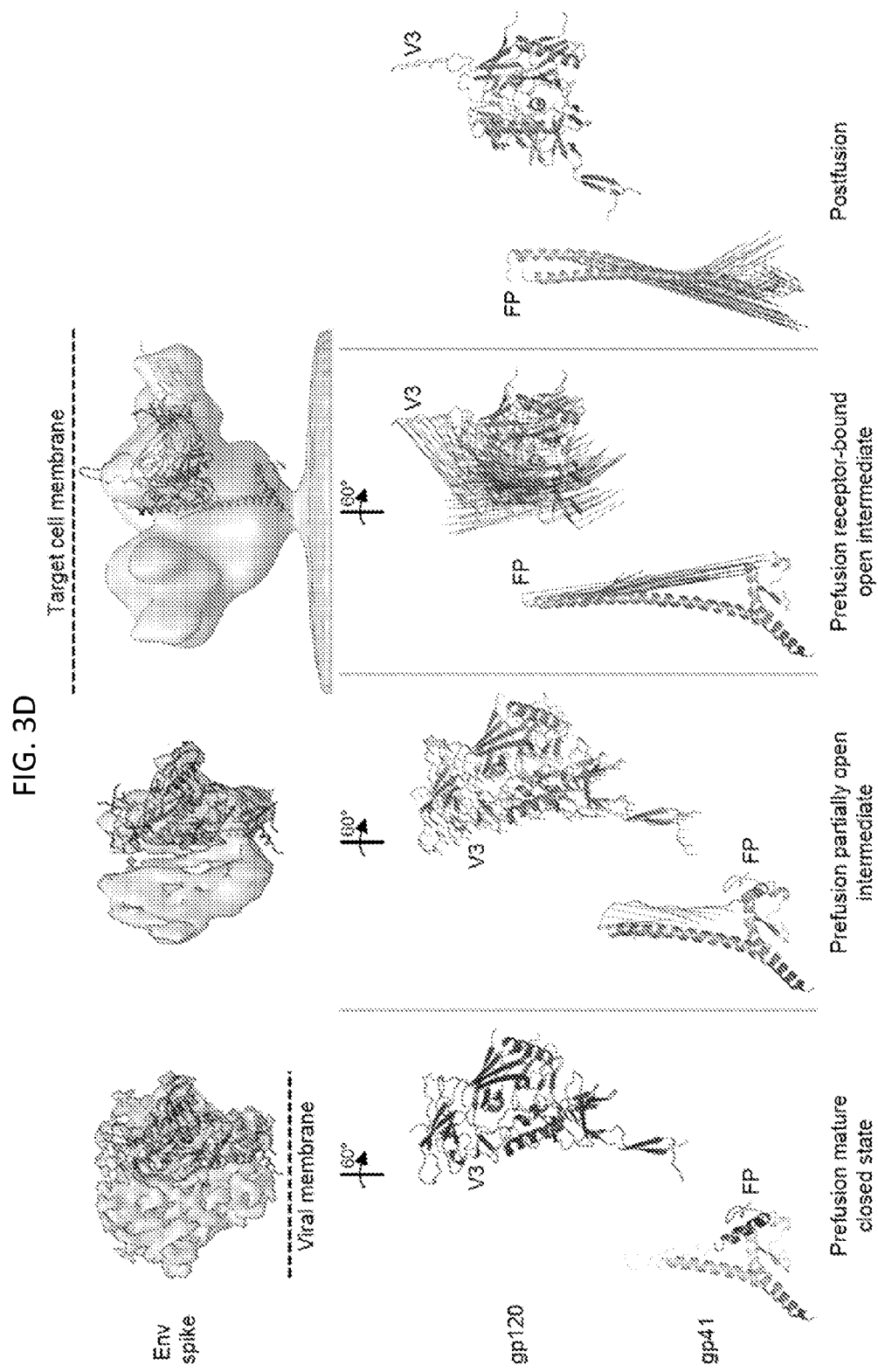

The HIV-1 Env trimer undergoes a dramatic structural rearrangement between its prefusion mature closed conformation and the CD4-bound open conformation (see Example 1, below). As shown in FIGS. 1-3, in the prefusion mature closed conformation, the HIV-1 Env trimer includes a V1V2 domain "cap" at its membrane distal apex, with the V1V2 domain of each gp120-gp41 protomer in the trimer coming together at the membrane distal apex. At the membrane proximal aspect, the HIV-1 Env ectodomain trimer includes distinct α6 and α7 helices. CD4 binding causes changes in the conformation of the HIV-1 Env ectodomain trimer, including disruption of the V1V1 domain cap, which "opens" as each V1V2 domain moves outward from the longitudinal axis of the Env trimer following CD4 binding, and formation of the HR1 helix, which includes both the α6 and α7 helices (which are no longer distinct, see FIG. 3D). These conformational changes bring the N-terminus of the fusion peptide within close proximity of the target cell membrane, and expose "CD4-induced" epitopes (such as the 17b epitope) that are present in the CD4-bound open conformation, but not the mature closed conformation, of the HIV-1 Env ectodomain trimer.

Thus, the membrane distal and membrane proximal aspects of the HIV-1 Env ectodomain trimer in its prefusion mature closed conformation include several distinct structural elements that are absent from the corresponding regions of the HIV-1 Env ectodomain trimer in its CD4-bound open conformation. Amino acid positions (and sequences) corresponding to these regions are indicated in FIGS. 3 and 11.

Notably, in a previously identified HIV-1 Env ectodomain triner (BG505.SOSIP, described in more detail in Example 1), CD4 triggered recognition by ineffective antibodies so that their average binding was tighter than that of broadly neutralizing antibodies (see Example 2, FIG. 33A). Such CD4 triggering makes HIV-1 Env ectodomain trimers that cannot resist conformational changes to the CD-bound open conformation less desirable as an immunogen: in primates, such immunogens would bind CD4 in vivo and would thus be expected to elicit production of primarily ineffective antibodies against highly immunogenic CD4-induced epitopes.

Accordingly, recombinant HIV-1 Env proteins are provided that are stabilized or "locked" in the prefusion mature closed conformation. Using structure-guided design, positions of the HIV-1 Env protein were targeted for modification (e.g., amino acid substitution) to hinder or prevent the HIV-1 Env ectodomain trimer from transitioning from the prefusion mature closed conformation to CD4-bound open conformations. These recombinant HIV-1 Env ectodomain trimers resist transition to the CD4-bound open state of HIV-1 Env, and thus will retain the prefusion mature closed conformation when used as an immunogen to generate an immune response to HIV-1 Env in a subject expressing CD4, such as a human.

I. Summary of Terms

Unless otherwise noted, technical terms are used according to conventional usage. Definitions of common terms in molecular biology may be found in Benjamin Lewin, Genes X, published by Jones & Bartlett Publishers, 2009; and Meyers et al. (eds.), *The Encyclopedia of Cell Biology and Molecular Medicine*, published by Wiley-VCH in 16 volumes, 2008; and other similar references.

As used herein, the singular forms "a," "an," and "the," refer to both the singular as well as plural, unless the context clearly indicates otherwise. For example, the term "an antigen" includes single or plural antigens and can be considered equivalent to the phrase "at least one antigen." As used herein, the term "comprises" means "includes." It is further to be understood that any and all base sizes or amino acid sizes, and all molecular weight or molecular mass values, given for nucleic acids or polypeptides are approximate, and are provided for descriptive purposes, unless otherwise indicated. Although many methods and materials similar or equivalent to those described herein can be used, particular suitable methods and materials are described herein. In case of conflict, the present specification, including explanations of terms, will control. In addition, the materials, methods, and examples are illustrative only and not intended to be limiting. To facilitate review of the various embodiments, the following explanations of terms are provided:

17b: A monoclonal antibody that specifically binds to a CD4-induced epitope on the HIV-1 Env ectodomain trimer, that is, CD4 binding causes a conformation change in the HIV-1 Env ectodomain trimer that exposes the 17b epitope. Thus, 17b mAb is a "CD4-induced" antibody. The 17b antibody does not specifically bind to the HIV-1 Env ectodomain trimer in its prefusion mature closed conformation. The person of ordinary skill in the art is familiar with monoclonal antibody 17b and with methods of producing this antibody (see, for example, Kwong et al., J. Biol. Chem., 274, 4115-4123, 1999, which is incorporated by reference herein). The amino acid sequences of the heavy and light variable regions of the 17b antibody are known and have been deposited in GenBank as Nos. 1G9N_H (17b $V_H$) and 1G9N_L (17b $V_L$), each of which is incorporated by reference herein as present in the database on Jun. 20, 2014).

35O22: A neutralizing monoclonal antibody that specifically binds to an epitope on the membrane-proximal region of HIV-1 Env including residues of both gp120 and gp41. The amino acid sequences of the heavy and light variable regions of the 35O22 antibody are set forth as SEQ ID NOs: 2099 and 2100, respectively, and can be used to generate an antibody with the 35O22 antigen binding domain.

447-52D: A monoclonal antibody that specifically binds to the V3 loop of HIV-1 Env. The person of ordinary skill in the art is familiar with monoclonal antibody 447-52D and with methods of producing this antibody (see, for example, Stanfield et al., Structure, 12, 193-204, which is incorporated by reference herein). The amino acid sequences of the heavy and light variable regions of the 447-52D antibody are known and have been deposited in the Protein Data Bank as Nos. 1Q1J_H (447-52D $V_H$) and 1Q1J_L (447-52D $V_L$), each of which is incorporated by reference herein as present in the database on Jun. 20, 2014).

Adjuvant: A vehicle used to enhance antigenicity. In some embodiments, an adjuvant can include a suspension of minerals (alum, aluminum hydroxide, or phosphate) on which antigen is adsorbed; or water-in-oil emulsion, for example, in which antigen solution is emulsified in mineral oil (Freund incomplete adjuvant), sometimes with the inclusion of killed mycobacteria (Freund's complete adjuvant) to further enhance antigenicity (inhibits degradation of antigen and/or causes influx of macrophages). Immunostimulatory oligonucleotides (such as those including a CpG motif) can also be used as adjuvants. Adjuvants include biological molecules (a "biological adjuvant"), such as costimulatory molecules. Exemplary adjuvants include IL-2, RANTES, GM-CSF, TNF-α, IFN-γ, G-CSF, LFA-3, CD72, B7-1, B7-2, OX-40L, 4-1BBL and toll-like receptor (TLR) agonists, such as TLR-9 agonists. In some embodiments, the Adjuplex™ (Advanced BioAdjuvants) can be used with any of the recombinant HIV-1 Env ectodomain trimers to elicit an immune response to HIV-1 Env. The person of ordinary skill in the art is familiar with adjuvants (see, e.g., Singh (ed.) Vaccine Adjuvants and Delivery Systems. Wiley-Interscience, 2007). Adjuvants can be used in combination with the disclosed immunogens.

Administration: The introduction of a composition into a subject by a chosen route. Administration can be local or systemic. For example, if the chosen route is intravenous, the composition (such as a composition including a disclosed immunogen) is administered by introducing the composition into a vein of the subject. Exemplary routes of administration include, but are not limited to, oral, injection (such as subcutaneous, intramuscular, intradermal, intraperitoneal, and intravenous), sublingual, rectal, transdermal (for example, topical), intranasal, vaginal, and inhalation routes.

Agent: Any substance or any combination of substances that is useful for achieving an end or result; for example, a substance or combination of substances useful for inhibiting HIV infection in a subject. Agents include proteins, nucleic acid molecules, compounds, small molecules, organic compounds, inorganic compounds, or other molecules of interest. An agent can include a therapeutic agent (such as an anti-retroviral agent), a diagnostic agent or a pharmaceutical agent. In some embodiments, the agent is a protein agent (such as a recombinant HIV-1 Env polypeptide or immunogenic fragment thereof), or an anti-viral agent. The skilled artisan will understand that particular agents may be useful to achieve more than one result.

Amino acid substitutions: The replacement of one amino acid in a polypeptide with a different amino acid or with no amino acid (i.e., a deletion). In some examples, an amino acid in a polypeptide is substituted with an amino acid from a homologous polypeptide, for example, and amino acid in a recombinant Clade A HIV-1 Env polypeptide can be substituted with the corresponding amino acid from a Clade B HIV-1 Env polypeptide.

Antibody: An immunoglobulin, antigen-binding fragment, or derivative thereof, that specifically binds and recognizes an analyte (antigen) such as HIV-1 gp120, an antigenic fragment thereof, or a dimer or multimer of the antigen. The term "antibody" is used herein in the broadest sense and encompasses various antibody structures, including but not limited to monoclonal antibodies, polyclonal antibodies, multispecific antibodies (e.g., bispecific antibodies), and antibody fragments, so long as they exhibit the desired antigen-binding activity.

Non-limiting examples of antibodies include, for example, intact immunoglobulins and variants and fragments thereof known in the art that retain binding affinity for the antigen. Examples of antibody fragments include but are not limited to Fv, Fab, Fab', Fab'-SH, F(ab')$_2$; diabodies; linear antibodies; single-chain antibody molecules (e.g. scFv); and multispecific antibodies formed from antibody fragments. Antibody fragments include antigen binding fragments either produced by the modification of whole antibodies or those synthesized de novo using recombinant DNA methodologies (see, e.g., Kontermann and Dubel (Ed), Antibody Engineering, Vols. 1-2, $2^{nd}$ Ed., Springer Press, 2010).

Typically, a naturally occurring immunoglobulin has heavy (H) chains and light (L) chains interconnected by disulfide bonds. Immunoglobulin genes include the kappa, lambda, alpha, gamma, delta, epsilon and mu constant region genes, as well as the myriad immunoglobulin variable domain genes. There are two types of light chain, lambda (λ) and kappa (κ). There are five main heavy chain classes (or isotypes) which determine the functional activity of an antibody molecule: IgM, IgD, IgG, IgA and IgE.

Light and heavy chain variable regions contain a "framework" region interrupted by three hypervariable regions, also called "complementarity-determining regions" or "CDRs" (see, e.g., Kabat et al., *Sequences of Proteins of Immunological Interest*, U.S. Department of Health and Human Services, 1991). The sequences of the framework regions of different light or heavy chains are relatively conserved within a species. The framework region of an antibody, that is the combined framework regions of the constituent light and heavy chains, serves to position and align the CDRs in three-dimensional space. The CDRs are primarily responsible for binding to an epitope of an antigen.

A "monoclonal antibody" is an antibody produced by a single clone of B-lymphocytes or by a cell into which nucleic acid encoding the light and heavy chains of a single antibody have been transfected, or a progeny thereof. Monoclonal antibodies are produced by methods known to those of skill in the art, for instance by making hybrid antibody-forming cells from a fusion of myeloma cells with immune spleen cells. These fused cells and their progeny are termed "hybridomas." In some examples monoclonal antibodies are isolated from a subject. Monoclonal antibodies can have conservative amino acid substitutions which have substantially no effect on antigen binding or other immunoglobulin functions. (See, for example, Harlow & Lane, *Antibodies, A Laboratory Manual*, $2^{nd}$ ed. Cold Spring Harbor Publications, New York (2013).)

Antigen: A compound, composition, or substance that can stimulate the production of antibodies or a T cell response in an animal, including compositions that are injected or absorbed into an animal. An antigen reacts with the products of specific humoral or cellular immunity, including those induced by heterologous antigens, such as the disclosed HIV antigens. Examples of antigens include, but are not limited to, polypeptides, peptides, lipids, polysaccharides, combinations thereof (such as glycopeptides) and nucleic acids containing antigenic determinants, such as those recognized by an immune cell. In some examples, antigens include peptides derived from a pathogen of interest, such as HIV. An antigen can include one or more epitopes.

Anti-retroviral agent: An agent that specifically inhibits a retrovirus from replicating or infecting cells. Non-limiting examples of antiretroviral drugs include entry inhibitors (e.g., enfuvirtide), CCR5 receptor antagonists (e.g., aplaviroc, vicriviroc, maraviroc), reverse transcriptase inhibitors (e.g., lamivudine, zidovudine, abacavir, tenofovir, emtricitabine, efavirenz), protease inhibitors (e.g., lopivar, ritonavir, raltegravir, darunavir, atazanavir), maturation inhibitors (e.g., alpha interferon, bevirimat and vivecon).

Anti-retroviral therapy (ART): A therapeutic treatment for HIV infection involving administration of at least one anti-retroviral agents (e.g., one, two, three or four anti-retroviral agents) to an HIV infected individual during a course of treatment. Non-limiting examples of antiretroviral agents include entry inhibitors (e.g., enfuvirtide), CCR5 receptor antagonists (e.g., aplaviroc, vicriviroc, maraviroc), reverse transcriptase inhibitors (e.g., lamivudine, zidovudine, abacavir, tenofovir, emtricitabine, efavirenz), protease inhibitors (e.g., lopivar, ritonavir, raltegravir, darunavir, atazanavir), maturation inhibitors (e.g., alpha interferon, bevirimat and vivecon). One example of an ART regimen includes treatment with a combination of tenofovir, emtricitabine and efavirenz. In some examples, ART include Highly Active Anti-Retroviral Therapy (HAART).

Atomic coordinates or structure coordinates: Mathematical coordinates derived from mathematical equations related to the patterns obtained on diffraction of a monochromatic beam of X-rays by the atoms (scattering centers) such as an antigen, or an antigen in complex with an antibody. In some examples that antigen can be HIV-1 Env polypeptide (for example stabilized in a prefusion conformation by binding to a prefusion-specific antibody, or by introduction of stabilizing modifications) in a crystal. The diffraction data are used to calculate an electron density map of the repeating unit of the crystal. The electron density maps are used to establish the positions of the individual atoms within the unit cell of the crystal. In one example, the term "structure coordinates" refers to Cartesian coordinates derived from mathematical equations related to the patterns obtained on diffraction of a monochromatic beam of X-rays, such as by the atoms of a HIV-1 Env polypeptide in crystal form.

Those of ordinary skill in the art understand that a set of structure coordinates determined by X-ray crystallography is not without standard error. For the purpose of this disclosure, any set of structure coordinates that have a root mean square deviation of protein backbone atoms (N, Cα, C and O) of less than about 1.0 Angstroms when superimposed, such as about 0.75, or about 0.5, or about 0.25 Angstroms, using backbone atoms, shall (in the absence of an explicit statement to the contrary) be considered identical.

Cavity-filling amino acid substitution: An amino acid substitution that fills a cavity within the protein core of the HIV-1 Env ectodomain trimer. Cavities are essentially voids within a folded protein where amino acids or amino acid side chains are not present. In several embodiments, a cavity filling amino acid substitution is introduced to fill a cavity in the HIV-1 Env ectodomain trimer core present in the prefusion mature closed conformation of HIV-1 Env ectodomain trimer that collapses (e.g., has reduced volume) upon transition to the CD4-bound open conformation.

CD4: Cluster of differentiation factor 4 polypeptide; a T-cell surface protein that mediates interaction with the MHC class II molecule. CD4 also serves as the primary receptor site for HIV on T-cells during HIV infection. CD4 is known to bind to gp120 from HIV-1 Env. The sequence of the CD4 precursor has a hydrophobic signal peptide, an extracellular region of approximately 370 amino acids, a highly hydrophobic stretch with significant identity to the membrane-spanning domain of the class II MHC beta chain, and a highly charged intracellular sequence of 40 resides (Maddon, *Cell* 42:93, 1985). The amino acid sequence of human CD4 is deposited in GenBank as No. P01730.1. Several embodiments utilize soluble CD4 (sCD4), which includes the extracellular domain of CD4 (without the signal peptide), approximately CD4 amino acids 26-390 (e.g., SEQ ID NO: 2118). Soluble CD4 can be obtained commercially (e.g., from Mybiosource); methods of its production are well known in the art.

CD4-induced antibody: An antibody that binds to an epitope present on the CD4-bound open conformation of the HIV-1 Env ectodomain trimer, but not present on the mature closed conformation of the HIV-1 Env ectodomain trimer. An example of a CD4-induced antibody is 17b mAb.

Conditions sufficient to form an immune complex: Conditions which allow an antibody or antigen binding fragment thereof to bind to its cognate epitope to a detectably greater degree than, and/or to the substantial exclusion of, binding to substantially all other epitopes. Conditions sufficient to form an immune complex are dependent upon the format of the binding reaction and typically are those utilized in immunoassay protocols or those conditions encountered in vivo. See Harlow & Lane, *Antibodies, A Laboratory Manual,* $2^{nd}$ ed. Cold Spring Harbor Publications, New York (2013) for a description of immunoassay formats and conditions. The conditions employed in the methods are "physiological conditions" which include reference to conditions (e.g., temperature, osmolarity, pH) that are typical inside a living mammal or a mammalian cell. While it is recognized that some organs are subject to extreme conditions, the intra-organismal and intracellular environment normally lies around pH 7 (e.g., from pH 6.0 to pH 8.0, more typically pH 6.5 to 7.5), contains water as the predominant solvent, and exists at a temperature above 0° C. and below 50° C. Osmolarity is within the range that is supportive of cell viability and proliferation.

Conservative variants: "Conservative" amino acid substitutions are those substitutions that do not substantially affect or decrease a function of a protein, such as the ability of the protein to induce an immune response when administered to a subject. The term conservative variation also includes the use of a substituted amino acid in place of an unsubstituted parent amino acid. Furthermore, one of ordinary skill will recognize that individual substitutions, deletions or additions which alter, add or delete a single amino acid or a small percentage of amino acids (for instance less than 5%, in some embodiments less than 1%) in an encoded sequence are conservative variations where the alterations result in the substitution of an amino acid with a chemically similar amino acid.

Conservative amino acid substitution tables providing functionally similar amino acids are well known to one of ordinary skill in the art. The following six groups are examples of amino acids that are considered to be conservative substitutions for one another:

1) Alanine (A), Serine (S), Threonine (T);
2) Aspartic acid (D), Glutamic acid (E);
3) Asparagine (N), Glutamine (Q);
4) Arginine (R), Lysine (K);
5) Isoleucine (I), Leucine (L), Methionine (M), Valine (V); and
6) Phenylalanine (F), Tyrosine (Y), Tryptophan (W).

Non-conservative substitutions are those that reduce an activity or function of the recombinant Env protein, such as the ability to induce an immune response when administered to a subject. For instance, if an amino acid residue is essential for a function of the protein, even an otherwise conservative substitution may disrupt that activity. Thus, a conservative substitution does not alter the basic function of a protein of interest.

Circular permutant: A modified recombinant protein in which the connections between different regions of a protein tertiary structure is modified, so that the relative order of different regions in the primary sequence is altered, but the placement of the regions in the tertiary structure is preserved. For example, with a 4-stranded antiparallel sheet, with strand A, B, C and D, which has the following N and C termini and connectivity:

Nterm-strand A-linker-strand B-linker-strand C-linker-strand D-Cterm,
circular permutants of the 4 strands, A, B, C and D by altering linker connection between strands can include:
Permutation with N- and C-termini altered:
Nterm-strand C-linker-strand D-linker-strand A-linker-strand B-Cterm
Permutation with N terminus preserved:
Nterm-strand A-linker-strand D-linker-strand C-linker-strand B-C term
Permutation with C terminus preserved:
Nterm-strand C-linker-strand B-linker-strand A-linker-strand D-C term.

Contacting: Placement in direct physical association; includes both in solid and liquid form, which can take place either in vivo or in vitro. Contacting includes contact between one molecule and another molecule, for example the amino acid on the surface of one polypeptide, such as a peptide, that contacts another polypeptide. Contacting can also include contacting a cell for example by placing a polypeptide in direct physical association with a cell.

Control: A reference standard. In some embodiments, the control is a negative control sample obtained from a healthy patient. In other embodiments, the control is a positive control sample obtained from a patient diagnosed with HIV infection. In still other embodiments, the control is a historical control or standard reference value or range of values (such as a previously tested control sample, such as a group of HIV patients with known prognosis or outcome, or group of samples that represent baseline or normal values).

A difference between a test sample and a control can be an increase or conversely a decrease. The difference can be a qualitative difference or a quantitative difference, for example a statistically significant difference. In some examples, a difference is an increase or decrease, relative to a control, of at least about 5%, such as at least about 10%, at least about 20%, at least about 30%, at least about 40%, at least about 50%, at least about 60%, at least about 70%, at least about 80%, at least about 90%, at least about 100%, at least about 150%, at least about 200%, at least about 250%, at least about 300%, at least about 350%, at least about 400%, at least about 500%, or greater than 500%.

Degenerate variant: In the context of the present disclosure, a "degenerate variant" refers to a polynucleotide encoding a polypeptide (such as a recombinant HIV-1 Env ectodomain or immunogenic fragment thereof) that includes a sequence that is degenerate as a result of the genetic code. There are 20 natural amino acids, most of which are specified by more than one codon. Therefore, all degenerate nucleotide sequences encoding a peptide are included as long as the amino acid sequence of the peptide encoded by the nucleotide sequence is unchanged.

Detecting: To identify the existence, presence, or fact of something. General methods of detecting are known to the skilled artisan and may be supplemented with the protocols and reagents disclosed herein. For example, included herein are methods of detecting the level of a protein in a sample or a subject.

Epitope: An antigenic determinant. These are particular chemical groups or peptide sequences on a molecule that are antigenic, such that they elicit a specific immune response, for example, an epitope is the region of an antigen to which B and/or T cells respond. An antibody can bind to a particular antigenic epitope, such as an epitope on HIV-1 Env.

Expression: Transcription or translation of a nucleic acid sequence. For example, a gene is expressed when its DNA is transcribed into an RNA or RNA fragment, which in some examples is processed to become mRNA. A gene may also be expressed when its mRNA is translated into an amino acid sequence, such as a protein or a protein fragment. In a particular example, a heterologous gene is expressed when it is transcribed into an RNA. In another example, a heterologous gene is expressed when its RNA is translated into an amino acid sequence. The term "expression" is used herein to denote either transcription or translation. Regulation of expression can include controls on transcription, translation, RNA transport and processing, degradation of intermediary molecules such as mRNA, or through activation, inactivation, compartmentalization or degradation of specific protein molecules after they are produced.

Expression control sequences: Nucleic acid sequences that regulate the expression of a heterologous nucleic acid sequence to which it is operatively linked. Expression control sequences are operatively linked to a nucleic acid sequence when the expression control sequences control and regulate the transcription and, as appropriate, translation of the nucleic acid sequence. Thus expression control sequences can include appropriate promoters, enhancers, transcription terminators, a start codon (ATG) in front of a protein-encoding gene, splicing signal for introns, maintenance of the correct reading frame of that gene to permit proper translation of mRNA, and stop codons. The term "control sequences" is intended to include, at a minimum, components whose presence can influence expression, and can also include additional components whose presence is advantageous, for example, leader sequences and fusion partner sequences. Expression control sequences can include a promoter.

A promoter is a minimal sequence sufficient to direct transcription. Also included are those promoter elements which are sufficient to render promoter-dependent gene expression controllable for cell-type specific, tissue-specific, or inducible by external signals or agents; such elements may be located in the 5' or 3' regions of the gene. Both constitutive and inducible promoters are included (see for example, Bitter et al., *Methods in Enzymology* 153:516-544, 1987). For example, when cloning in bacterial systems, inducible promoters such as pL of bacteriophage lambda, plac, ptrp, ptac (ptrp-lac hybrid promoter) and the like may be used. In one embodiment, when cloning in mammalian cell systems, promoters derived from the genome of mammalian cells (such as metallothionein promoter) or from mammalian viruses (such as the retrovirus long terminal repeat; the adenovirus late promoter; the vaccinia virus 7.5K promoter) can be used. Promoters produced by recombinant DNA or synthetic techniques may also be used to provide for transcription of the nucleic acid sequences.

A polynucleotide can be inserted into an expression vector that contains a promoter sequence which facilitates the efficient transcription of the inserted genetic sequence of the host. The expression vector typically contains an origin of replication, a promoter, as well as specific nucleic acid sequences that allow phenotypic selection of the transformed cells.

Expression vector: A vector comprising a recombinant polynucleotide comprising expression control sequences operatively linked to a nucleotide sequence to be expressed. An expression vector comprises sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide.

Heterologous: Originating from a different genetic source. A nucleic acid molecule that is heterologous to a cell originated from a genetic source other than the cell in which it is expressed. In one specific, non-limiting example, a heterologous nucleic acid molecule encoding a recombinant HIV-1 Env polypeptide is expressed in a cell, such as a mammalian cell. Methods for introducing a heterologous nucleic acid molecule in a cell or organism are well known in the art, for example transformation with a nucleic acid, including electroporation, lipofection, particle gun acceleration, and homologous recombination.

F105: A monoclonal antibody that specifically binds to a conformational epitope on HIV-1 Env that is not present on the prefusion mature closed conformation. The F105 antibody does not specifically bind to HIV-1 Env in its prefusion mature closed conformation. The person of ordinary skill in the art is familiar with monoclonal antibody F105 and with methods of producing this antibody (see, for example, Posner et al. *J Acquired Immune Defic Syndr* 6:7-14, 1993; which is incorporated by reference herein). The amino acid sequences of the heavy and light variable regions of the F105 antibody are known and have been deposited in the Protein Data Bank (PDB) as No. 1U6A_H (F105 $V_H$) and 1U6A-L (F105 $V_L$), each of which is incorporated by reference herein as present in the database on Jun. 20, 2014).

Ferritin: A protein that stores iron and releases it in a controlled fashion. The protein is produced by almost all living organisms. Ferritin polypeptides assemble into a globular protein complex of 24 protein subunits, each of the 24 subunits includes a single ferritin polypeptide. In some examples, ferritin is used to form a nanoparticle presenting antigens on its surface, for example, an HIV antigen.

Foldon domain: An amino acid sequence that naturally forms a trimeric structure. In some examples, a Foldon domain can be included in the amino acid sequence of a disclosed recombinant protein so that the antigen will form a trimer. In one example, a Foldon domain is the T4 Foldon domain including the amino acid sequence set forth as (GYIPEAPRDGQAYVRKDGEWVLLSTF (SEQ ID NO: 578). Several embodiments include a Foldon domain that can be cleaved from a purified protein, for example by incorporation of a thrombin cleave site adjacent to the Foldon domain that can be used for cleavage purposes.

Glycosylation site: An amino acid sequence on the surface of a polypeptide, such as a protein, which accommodates the attachment of a glycan. An N-linked glycosylation site is triplet sequence of NX(S/T) in which N is asparagine, X is any residues except proline, and (S/T) is a serine or threonine residue. A glycan is a polysaccharide or oligosaccharide. Glycan may also be used to refer to the carbohydrate portion of a glycoconjugate, such as a glycoprotein, glycolipid, or a proteoglycan.

Homologous proteins: Proteins that have a similar structure and function, for example, proteins from two or more species or viral strains that have similar structure and function in the two or more species or viral strains. For example a HIV-1 Env protein from a Clade A virus is a homologous protein to a HIV-1 Env protein from Clade B virus. Homologous proteins share similar protein folding characteristics and can be considered structural homologs.

Homologous proteins typically share a high degree of sequence conservation, such as at least 80%, at least 90%, at least 91%, at least 92%, at least 93%, at least 94%, or at least 95%, at least 96%, at least 97%, at least 98%, or at least 99% sequence conservation, and a high degree of sequence identity, such as at least 80%, at least 90%, at least 91%, at least 92%, at least 93%, at least 94%, or at least 95%, at least 96%, at least 97%, at least 98%, or at least 99% sequence identity.

Host cells: Cells in which a vector can be propagated and its DNA expressed. The cell may be prokaryotic or eukaryotic. The term also includes any progeny of the subject host cell. It is understood that all progeny may not be identical to the parental cell since there may be mutations that occur during replication. However, such progeny are included when the term "host cell" is used.

Human Immunodeficiency Virus (HIV): A retrovirus that causes immunosuppression in humans (HIV disease), and leads to a disease complex known as the acquired immunodeficiency syndrome (AIDS). "HIV disease" refers to a well-recognized constellation of signs and symptoms (including the development of opportunistic infections) in persons who are infected by an HIV virus, as determined by antibody or western blot studies. Laboratory findings associated with this disease include a progressive decline in T cells. HIV includes HIV type 1 (HIV-1) and HIV type 2 (HIV-2). Related viruses that are used as animal models include simian immunodeficiency virus (SIV), and feline immunodeficiency virus (FIV). Treatment of HIV-1 with HAART has been effective in reducing the viral burden and ameliorating the effects of HIV-1 infection in infected individuals.

HIV-1 broadly neutralizing antibody: An antibody that reduces the infectious titer of HIV-1 by binding to and inhibiting the function of related HIV-1 antigens, such as antigens that share at least 85%, 90%, 95%, 96%, 97%, 98% or 99% sequence identity with antigenic surface of the antigen. In some embodiments, broadly neutralizing antibodies to HIV are distinct from other antibodies to HIV in that they neutralize a high percentage (such as at least 50% or at least 80%) of the many types of HIV in circulation. Non-limiting examples of HIV-1 broadly neutralizing antibodies include PGT122, VRC01, and 35O22.

HIV envelope protein (Env): The HIV envelope protein is initially synthesized as a precursor protein of 845-870 amino acids in size, designated gp160. Individual gp160 polypeptides form a homotrimer and undergo glycosylation within the Golgi apparatus as well as processing to remove the signal peptide, and cleavage by a cellular protease between approximately positions 511/512 to generate separate gp120 and gp41 polypeptide chains, which remain associated as gp120-gp41 protomers within the homotrimer. The ectodomain (that is, the extracellular portion) of the HIV-1 Env trimer undergoes several structural rearrangements from a prefusion mature (cleaved) closed conformation that evades antibody recognition, through intermediate conformations that bind to receptors CD4 and co-receptor (either CCR5 or CXCR4), to a postfusion conformation. The HIV-1 Env ectodomain includes the gp120 protein (approximately HIV-1 Env positions 31-511) and the gp41 ectodomain (approximately HIV-1 Env positions 512-644). An HIV-1 Env ectodomain trimer includes a protein complex of three HIV-1 Env ectodomains.

Mature gp120 includes approximated HIV-1 Env residues 31-511, contains most of the external, surface-exposed, domains of the HIV-1 Env trimer, and it is gp120 which binds both to cellular CD4 receptors and to cellular chemokine receptors (such as CCR5). A mature gp120 polypeptide is an extracellular polypeptide that interacts with the gp41 ectodomain to form an HIV-1 Env protomer that trimerizes to form the HIV-1 Env trimer.

The mature gp120 wild-type polypeptide is heavily N-glycosylated, giving rise to an apparent molecular weight of 120 kD. Native gp120 includes five conserved regions (C1-C5) and five regions of high variability (V1-V5). See FIG. 11 for an illustration of gp120 primary and secondary structures.

Variable region 1 and Variable Region 2 (V1/V2 domain) of gp120 are comprised of ~50-90 residues which contain two of the most variable portions of HIV-1 (the V1 domain and the V2 loop), and one in ten residues of the V1/V2 domain are N-glycosylated. Despite the diversity and glycosylation of the V1/V2 domain, a number of broadly neutralizing human antibodies have been identified that target this region, including PG9 and PGT122. In some examples the V1/V2 domain includes gp120 positions 126-196. Variable region 3 (V3) of gp120 includes approximately 35-45 amino acids. In some examples the V1/V2 domain includes gp120 positions 296-331.

Mature gp41 includes approximately HIV-1 Env residues 512-860, and includes cytosolic-, transmembrane-, and ecto-domains. The gp41 ectodomain (including approximately HIV-1 Env residues 512-644) can interact with gp120 to form an HIV-1 Env protomer that trimerizes to form the HIV-1 Env trimer. See FIG. 3 for an illustration of the primary and secondary structure of a gp41 ectodomain.

The numbering used in the disclosed HIV-1 Env proteins and fragments thereof is relative to the HXB2 numbering scheme as set forth in *Numbering Positions in HIVRelative to HXB2CG* Bette Korber et al., *Human Retroviruses and AIDS* 1998: A Compilation and Analysis of Nucleic Acid and Amino Acid Sequences. Korber et al., Eds. Theoretical Biology and Biophysics Group, Los Alamos National Laboratory, Los Alamos, N. Mex., which is incorporated by reference herein in its entirety.

In one example, an HIV-1 Env protein is from the BG505 strain of HIV, which is a Clade A HIV-1 virus isolated from a six-week old HIV-1 infected infant. The amino acid sequence of BG505 Env protein is known (see, e.g., GenBank accession no. ABA61516, incorporated by reference herein as present in the database on Jun. 20, 2014), and set forth as SEQ ID NO: 2.

HIV-1 Env ectodomain trimer prefusion mature closed conformation: A structural conformation adopted by the ectodomain of the HIV-1 Env ectodomain trimer after cellular processing to a mature prefusion state with distinct gp120 and gp41 polypeptide chains, and before specific binding to the CD4 receptor. In the prefusion mature closed conformation, the HIV-1 Env ectodomain trimer includes a V1V2 domain "cap" at its membrane distal apex, with the V1V2 domain of each Env protomer in the trimer coming together at the membrane distal apex. At the membrane proximal aspect, the HIV-1 Env ectodomain trimer includes distinct α6 and α7 helices. CD4 binding to the Env trimer causes changes in the conformation of the HIV-1 Env ectodomain trimer, including disruption of the V1V1 domain cap, which "opens" as each V1V2 domain moves outward from the longitudinal axis of the Env trimer, and formation of the HR1 helix, which includes both the α6 and α7 helices (which are no longer distinct, see FIG. 3D). These conformational changes bring the N-terminus of the fusion peptide within close proximity of the target cell membrane, and expose "CD4-induced" epitopes (such as the 17b epitope) that are present in the CD4-bound open conformation, but not the mature closed conformation, of the HIV-1 Env ectodomain trimer. The three-dimensional structure of an exemplary HIV-1 Env ectodomain trimer in the prefusion mature closed conformation is disclosed herein (see Example 1).

HIV-1 Env ectodomain trimer stabilized in a prefusion mature closed conformation: A HIV-1 Env ectodomain trimer having a prefusion mature closed conformation and including one or more amino acid substitutions, deletions, or insertions compared to a native HIV-1 Env sequence that provide for increased retention of the prefusion mature closed conformation upon CD4 binding compared to a corresponding native HIV-1 Env sequence. In some embodiments, the HIV-1 Env ectodomain trimer can include one or more cysteine substitutions that allow formation of a non-natural disulfide bond that stabilizes the HIV-1 Env ectodomain trimer in its prefusion mature closed conformation.

A HIV-1 Env ectodomain trimer stabilized in the prefusion mature closed conformation has at least 90% (such as at least 95% or at least 99%) reduced transition to the CD4-bound open conformation upon CD4 binding compared to a corresponding native HIV-1 Env sequence. The "stabilization" of the prefusion mature closed conformation by the one or more amino acid substitutions, deletions, or insertions can be, for example, energetic stabilization (for example, reducing the energy of the prefusion mature closed conformation relative to the CD4-bound open conformation) and/or kinetic stabilization (for example, reducing the rate of transition from the prefusion mature closed conformation to the prefusion mature closed conformation). Additionally, stabilization of the HIV-1 Env ectodomain trimer in the prefusion mature closed conformation can include an increase in resistance to denaturation compared to a corresponding native HIV-1 Env sequence.

Methods of determining if a HIV-1 Env ectodomain trimer is in the prefusion mature closed conformation are provided herein, and include (but are not limited to) negative stain electron microscopy and antibody binding assays using a prefusion mature closed conformation specific antibody, such as VRC26 or PGT145. Methods of determining if a HIV-1 Env ectodomain trimer is in the CD4-bound open conformation are also provided herein, and include (but are not limited to) negative stain electron microscopy and antibody binding assays using a CD4-bound open conformation specific antibody, such as 17b, which binds to a CD4-induced epitope. Transition from the prefusion mature closed conformation upon CD4 binding can be assayed, for example, by incubating a HIV-1 Env ectodomain trimer of interest that is in the prefusion mature closed conformation with a molar excess of CD4, and determining if the HIV-1 Env ectodomain trimer retains the prefusion mature closed conformation (or transitions to the CD4-bound open conformation) by negative stain electron microscopy analysis, or antigenic analysis.

HIV-1 gp140: A recombinant HIV Env polypeptide including gp120 and the gp41 ectodomain, but not the gp41 transmembrane or cytosolic domains. HIV-1 gp140 polypeptides can trimerize to form a soluble HIV-1 Env ectodomain trimer.

HIV-1 gp145: A recombinant HIV Env polypeptide including gp120, the gp41 ectodomain, and the gp41 transmembrane domain. HIV-1 gp145 polypeptides can trimerize to form membrane bound HIV-1 Env ectodomain trimers.

HXB2 numbering system: A reference numbering system for HIV protein and nucleic acid sequences, using the HIV-1 HXB2 strain sequences as a reference for all other HIV-1 strain sequences. The person of ordinary skill in the art is familiar with the HXB2 numbering system, and this system is set forth in "Numbering Positions in HIV Relative to HXB2CG," Bette Korber et al., Human Retroviruses and AIDS 1998: A Compilation and Analysis of Nucleic Acid and Amino Acid Sequences. Korber B, Kuiken C L, Foley B, Hahn B, McCutchan F, Mellors J W, and Sodroski J, Eds. Theoretical Biology and Biophysics Group, Los Alamos National Laboratory, Los Alamos, N. Mex., which is incorporated by reference herein in its entirety. Unless context indicates otherwise, the numbering used in HIV-1 polypeptides disclosed herein is relative to the HXB2 numbering scheme. For reference, the amino acid sequence of HIV-1 Env of HXB2 is set forth as SEQ ID NO: 1 (GENBANK® Accession No. K03455, incorporated by reference herein as present in the database on Jun. 20, 2014).

Immune response: A response of a cell of the immune system, such as a B cell, T cell, or monocyte, to a stimulus. In one embodiment, the response is specific for a particular antigen (an "antigen-specific response"). In one embodiment, an immune response is a T cell response, such as a CD4+ response or a CD8+ response. In another embodiment, the response is a B cell response, and results in the production of specific antibodies. "Priming an immune response" refers to pre-treatment of a subject with an adjuvant to increase the desired immune response to a later administered immunogenic agent. "Enhancing an immune response" refers to co-administration of an adjuvant and an immunogenic agent, wherein the adjuvant increases the desired immune response to the immunogenic agent compared to administration of the immunogenic agent to the subject in the absence of the adjuvant.

Immunogen: A protein or a portion thereof that is capable of inducing an immune response in a mammal, such as a mammal infected or at risk of infection with a pathogen. Administration of an immunogen can lead to protective immunity and/or proactive immunity against a pathogen of interest. In some examples, an immunogen comprises a recombinant HIV-1 Env ectodomain trimer as disclosed herein.

Immunogenic composition: A composition comprising an immunogenic polypeptide, or a nucleic acid molecule or vector encoding an immunogenic polypeptide that induces a measurable CTL response against the immunogenic polypeptide, or induces a measurable B cell response (such as production of antibodies) against the immunogenic polypeptide. In one example, an "immunogenic composition" is a composition that includes a disclosed recombinant HIV-1 Env ectodomain trimer or immunogenic fragment thereof, that induces a measurable CTL response against an HIV-1 virus, or induces a measurable B cell response (such as production of antibodies) against a HIV-1. It further refers to isolated nucleic acids encoding an antigen, such as a nucleic acid that can be used to express the antigen (and thus be used to elicit an immune response against this peptide).

For in vitro use, an immunogenic composition may comprise or consist of the isolated protein or nucleic acid molecule encoding the protein. For in vivo use, the immunogenic composition will typically include the protein or nucleic acid molecule in a pharmaceutically acceptable carrier and may also include other agents, such as an adjuvant. Any particular protein, such as a disclosed recombinant HIV-1 Env ectodomain trimer or a nucleic acid encoding the protein, can be readily tested for its ability to induce a CTL or B cell response by art-recognized assays. Immunogenic compositions can include adjuvants, which are well known to one of skill in the art.

Immunogenic polypeptide: A polypeptide which comprises an allele-specific motif, an epitope or other sequence such that the polypeptide will bind an MHC molecule and induce an immune response, such as a cytotoxic T lymphocyte ("CTL") response, and/or a B cell response (for example, antibody production), and/or a T-helper lymphocyte response against the antigen from which the immunogenic polypeptide is derived.

Isolated: An "isolated" biological component (such as a protein, for example a disclosed immunogen or nucleic acid encoding such an antigen) has been substantially separated or purified away from other biological components, such as other biological components in which the component naturally occurs, such as other chromosomal and extrachromosomal DNA, RNA, and proteins. Proteins, peptides and nucleic acids that have been "isolated" include proteins purified by standard purification methods. The term also embraces proteins or peptides prepared by recombinant expression in a host cell as well as chemically synthesized proteins, peptides and nucleic acid molecules. Isolated does not require absolute purity, and can include protein, peptide, or nucleic acid molecules that are at least 50% isolated, such as at least 75%, 80%, 90%, 95%, 98%, 99%, or even 99.9% isolated. The HIV-1 Env proteins herein that are stabilized in a prefusion mature closed conformation can be isolated from HIV-1 Env proteins in a prefusion CD4 bound conformation, for example, can be at least 80% isolated, at least 90%, 95%, 98%, 99%, or even 99.9% isolated from HIV-1 Env proteins in a prefusion CD4 bound conformation.

$K_D$: The dissociation constant for a given interaction, such as a polypeptide ligand interaction or an antibody antigen interaction. For example, for the bimolecular interaction of an antibody or antigen binding fragment and an immunogen (such as HIV-1 Env polypeptide) it is the concentration of the individual components of the bimolecular interaction divided by the concentration of the complex.

Linker: A bi-functional molecule that can be used to link two molecules into one contiguous molecule, for example, to link a carrier molecule to a immunogenic polypeptide. Non-limiting examples of peptide linkers include glycine-serine linkers, such as a $(GGGGS)_x$ linker or a 10 amino acid glycine-serine linker. Unless context indicates otherwise, reference to "linking" a first polypeptide and a second polypeptide (or to two polypeptides "linked" together) refers to covalent linkage by peptide bond, or (if a peptide linker is involved) covalent linkage of the first and second polypeptides to the N and C termini of a peptide linker. Thus, reference to a gp120 polypeptide "linked" to a gp41 ectodomain by a peptide linker indicates that the gp120 polypeptide and the gp41 ectodomain are linked to opposite ends of the peptide linker by peptide bonds. Typically, such linkage is accomplished using molecular biology techniques to genetically manipulate DNA encoding the first polypeptide linked to the second polypeptide by the peptide linker.

The terms "conjugating," "joining," "bonding," can refer to making two molecules into one contiguous molecule; for example, joining two polypeptides into one contiguous polypeptide, or covalently attaching a carrier molecule or other molecule to an immunogenic polypeptide, such as an recombinant HIV-1 Env ectodomain as disclosed herein. The conjugate can be either by chemical or recombinant means. "Chemical means" refers to a reaction, for example, between the immunogenic polypeptide moiety and the carrier molecule such that there is a covalent bond formed between the two molecules to form one molecule.

Neutralizing antibody: An antibody which reduces the infectious titer of an infectious agent by binding to a specific antigen on the infectious agent. In some examples the infectious agent is a virus. In some examples, an antibody that is specific for HIV-1 Env neutralizes the infectious titer of HIV. A "broadly neutralizing antibody" is an antibody that binds to and inhibits the function of related antigens, such as antigens that share at least 85%, 90%, 95%, 96%, 97%, 98% or 99% identity antigenic surface of antigen. With regard to an antigen from a pathogen, such as a virus, the antibody can bind to and inhibit the function of an antigen from more than one class and/or subclass of the pathogen. For example, with regard to a human immunodeficiency virus, the antibody can bind to and inhibit the function of an antigen, such as HIV-1 Env from more than one clade. In one embodiment, broadly neutralizing antibodies to HIV are distinct from other antibodies to HIV in that they neutralize a high percentage of the many types of HIV in circulation.

Native protein, sequence, or di-sulfide bond: An polypeptide, sequence or di-sulfide bond that has not been modified, for example by selective mutation. For example, selective mutation to focus the antigenicity of the antigen to a target epitope, or to introduce a di-sulfide bond into a protein that does not occur in the native protein. Native protein or native sequence are also referred to as wild-type protein or wild-type sequence. A non-native di-sulfide bond is a disulfide bond that is not present in a native protein, for example a di-sulfide bond that forms in a protein due to introduction of one or more cysteine residues into the protein by genetic engineering.

Nucleic acid: A polymer composed of nucleotide units (ribonucleotides, deoxyribonucleotides, related naturally occurring structural variants, and synthetic non-naturally occurring analogs thereof) linked via phosphodiester bonds, related naturally occurring structural variants, and synthetic non-naturally occurring analogs thereof. It will be understood that when a nucleotide sequence is represented by a DNA sequence (i.e., A, T, G, C), this also includes an RNA sequence (i.e., A, U, G, C) in which "U" replaces "T."

"Nucleotide" includes, but is not limited to, a monomer that includes a base linked to a sugar, such as a pyrimidine, purine or synthetic analogs thereof, or a base linked to an amino acid, as in a peptide nucleic acid (PNA). A nucleotide is one monomer in a polynucleotide. A nucleotide sequence refers to the sequence of bases in a polynucleotide.

Conventional notation is used herein to describe nucleotide sequences: the left-hand end of a single-stranded nucleotide sequence is the 5'-end; the left-hand direction of a double-stranded nucleotide sequence is referred to as the 5'-direction. The direction of 5' to 3' addition of nucleotides to nascent RNA transcripts is referred to as the transcription direction. The DNA strand having the same sequence as an mRNA is referred to as the "coding strand;" sequences on the DNA strand having the same sequence as an mRNA transcribed from that DNA and which are located 5' to the 5'-end of the RNA transcript are referred to as "upstream sequences;" sequences on the DNA strand having the same sequence as the RNA and which are 3' to the 3' end of the coding RNA transcript are referred to as "downstream sequences."

"cDNA" refers to a DNA that is complementary or identical to an mRNA, in either single stranded or double stranded form.

"Encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (i.e., rRNA, tRNA and mRNA) or a defined sequence of amino acids and the biological properties resulting therefrom. Thus, a gene encodes a protein if transcription and translation of mRNA produced by that gene produces the protein in a cell or other biological system. Both the coding strand, the nucleotide sequence of which is identical to the mRNA sequence and is usually provided in sequence listings, and non-coding strand, used as the template for transcription, of a gene or cDNA can be referred to as encoding the protein or other product of that gene or cDNA. Unless otherwise specified, a "nucleotide sequence encoding an amino acid sequence" includes all nucleotide sequences that are degenerate versions of each other and that encode the same amino acid sequence. Nucleotide sequences that encode proteins and RNA may include introns.

Operably linked: A first nucleic acid sequence is operably linked with a second nucleic acid sequence when the first nucleic acid sequence is placed in a functional relationship with the second nucleic acid sequence. For instance, a promoter, such as the CMV promoter, is operably linked to a coding sequence if the promoter affects the transcription or expression of the coding sequence. Generally, operably linked DNA sequences are contiguous and, where necessary to join two protein-coding regions, in the same reading frame.

PGT121, PGT122, and PGT123: A family of neutralizing monoclonal antibodies that specifically bind to the V1/V2 and V3 regions of HIV-1 Env and can inhibit HIV-1 infection of target cells. The person of ordinary skill in the art is familiar with the PGT121, PGT122, and PGT123 mAbs and with methods of producing them (see, for example, Walker et al., Nature, 477:466-470, 2011, and Int. Pub. No. WO 2012/030904, each of which is incorporated by reference herein). The amino acid sequences of the heavy and light variable regions of the PGT121, PGT122, and PGT123 antibodies are known and have been deposited in GenBank as Nos. AEN14390.1 (PGT121 $V_H$), AEN14407.1 (PGT121 $V_L$), JN201895.1 (PGT122 $V_H$), JN201912.1 (PGT122 $V_L$), JN201896.1 (PGT123 $V_H$), and JN201913.1 (PGT123 $V_L$), each of which is incorporated by reference herein as present in the database on Jun. 20, 2014)

PGT141, PGT142, PGT143, and PGT145: A family of broadly neutralizing monoclonal antibodies that specifically bind to the V1/V2 domain of the HIV-1 Env ectodomain trimer in its prefusion mature closed conformation, and which can inhibit HIV-1 infection of target cells. The person of ordinary skill in the art is familiar with the PGT141, PGT142, PGT143, and PGT145 mAbs and with methods of producing them (see, for example, Walker et al., Nature, 477:466-470, 2011, and Int. Pub. No. WO2012/030904, each of which is incorporated by reference herein). The amino acid sequences of the heavy and light variable regions of the PGT141, PGT142, PGT143, PGT144, and PGT145 mAbs are known and have been deposited in GenBank as Nos. JN201906.1 (PGT141 $V_H$), JN201923.1 (PGT141 $V_L$), JN201907.1 (PGT142 $V_H$), JN201924.1 (PGT142 $V_L$), JN201908.1 (PGT143 $V_H$), JN201925.1 (PGT143 $V_L$), JN201909.1 (PGT144 $V_H$), JN201926.1 (PGT144 $V_L$), JN201910.1 (PGT145 $V_H$), and JN201927.1 (PGT145 $V_L$), each of which is incorporated by reference herein as present in the database on Jun. 20, 2014).

PGT151: A broadly neutralizing monoclonal antibody that specifically bind to the gp120/gp41 interface of HIV-1 Env in its prefusion mature (cleaved) conformation, and which can inhibit HIV-1 infection of target cells. The person of ordinary skill in the art is familiar with the PGT151 antibody and with methods of producing this antibody (see, for example, Blattner et al., Immunity, 40, 669-680, 2014, and Falkowska et al., Immunity, 40, 657-668, 2014, each of which is incorporated by reference herein). The amino acid sequences of the heavy and light variable regions of the PGT151 mAb are known and have been deposited in GenBank as Nos. KJ700282.1 (PGT151 $V_H$) and KJ700290.1 (PGT151 $V_L$), each of which is incorporated by reference herein as present in the database on Jun. 20, 2014).

Pharmaceutically acceptable carriers: The pharmaceutically acceptable carriers of use are conventional. *Remington's Pharmaceutical Sciences*, by E. W. Martin, Mack Publishing Co., Easton, Pa., 19th Edition, 1995, describes compositions and formulations suitable for pharmaceutical delivery of the disclosed immunogens.

In general, the nature of the carrier will depend on the particular mode of administration being employed. For instance, parenteral formulations usually comprise injectable fluids that include pharmaceutically and physiologically acceptable fluids such as water, physiological saline, balanced salt solutions, aqueous dextrose, glycerol or the like as a vehicle. For solid compositions (e.g., powder, pill, tablet, or capsule forms), conventional non-toxic solid carriers can include, for example, pharmaceutical grades of mannitol, lactose, starch, or magnesium stearate. In addition to biologically neutral carriers, pharmaceutical compositions to be administered can contain minor amounts of non-toxic auxiliary substances, such as wetting or emulsifying agents, preservatives, and pH buffering agents and the like, for example sodium acetate or sorbitan monolaurate. In particular embodiments, suitable for administration to a subject the carrier may be sterile, and/or suspended or otherwise contained in a unit dosage form containing one or more measured doses of the composition suitable to induce the desired anti-HIV-1 immune response. It may also be accompanied by medications for its use for treatment purposes. The unit dosage form may be, for example, in a sealed vial that contains sterile contents or a syringe for injection into a subject, or lyophilized for subsequent solubilization and administration or in a solid or controlled release dosage.

Polypeptide: Any chain of amino acids, regardless of length or post-translational modification (e.g., glycosylation or phosphorylation). "Polypeptide" applies to amino acid polymers including naturally occurring amino acid polymers and non-naturally occurring amino acid polymer as well as in which one or more amino acid residue is a non-natural amino acid, for example an artificial chemical mimetic of a corresponding naturally occurring amino acid. A "residue" refers to an amino acid or amino acid mimetic incorporated in a polypeptide by an amide bond or amide bond mimetic. A polypeptide has an amino terminal (N-terminal) end and a carboxy terminal (C-terminal) end. "Polypeptide" is used interchangeably with peptide or protein, and is used herein to refer to a polymer of amino acid residues. A protein can include multiple polypeptide chains; for example, mature HIV-1 Env includes gp120 and gp41 polypeptide chains. Additionally, a single contiguous polypeptide chain of amino acid residues can include multiple polypeptides. For example, a single chain HIV-1 Env can include a gp120 polypeptide linked to a gp41 polypeptide by a peptide linker.

In many instances, one or more polypeptides can fold into a specific three-dimensional structure including surface-exposed amino acid residues and non-surface-exposed amino acid residues. In some instances a protein can include multiple polypeptides that fold together into a functional unit. For example, the HIV-1 Env protein is composed of three gp120-gp41 protomers that trimerize in to a multimeric protein. "Surface-exposed amino acid residues" are those amino acids that have some degree of exposure on the surface of the protein, for example such that they can contact the solvent when the protein is in solution. In contrast, non-surface-exposed amino acids are those amino acid residues that are not exposed on the surface of the protein, such that they do not contact solution when the protein is in solution. In some examples, the non-surface-exposed amino acid residues are part of the protein core.

A "protein core" is the interior of a folded protein, which is substantially free of solvent exposure, such as solvent in the form of water molecules in solution. Typically, the protein core is predominately composed of hydrophobic or apolar amino acids. In some examples, a protein core may contain charged amino acids, for example aspartic acid, glutamic acid, arginine, and/or lysine. The inclusion of uncompensated charged amino acids (a compensated charged amino can be in the form of a salt bridge) in the protein core can lead to a destabilized protein. That is, a protein with a lower $T_m$ then a similar protein without an uncompensated charged amino acid in the protein core. In other examples, a protein core may have a cavity within the protein core. Cavities are essentially voids within a folded protein where amino acids or amino acid side chains are not present. Such cavities can also destabilize a protein relative to a similar protein without a cavity. Thus, when creating a stabilized form of a protein, it may be advantageous to substitute amino acid residues within the core in order to fill cavities present in the wild-type protein.

Polypeptide modifications: Polypeptides and peptides, such as the recombinant HIV-1 Env proteins disclosed herein can be modified by a variety of chemical techniques to produce derivatives having essentially the same activity as the unmodified peptides, and optionally having other desirable properties. For example, carboxylic acid groups of the protein, whether carboxyl-terminal or side chain, may be provided in the form of a salt of a pharmaceutically-acceptable cation or esterified to form a $C_1$-$C_{16}$ ester, or converted to an amide of formula $NR_1R_2$ wherein $R_1$ and $R_2$ are each independently H or $C_1$-$C_{16}$ alkyl, or combined to form a heterocyclic ring, such as a 5- or 6-membered ring. Amino groups of the peptide, whether amino-terminal or side chain, may be in the form of a pharmaceutically-acceptable acid addition salt, such as the HCl, HBr, acetic, benzoic, toluene sulfonic, maleic, tartaric and other organic salts, or may be modified to $C_1$-$C_{16}$ alkyl or dialkyl amino or further converted to an amide. Hydroxyl groups of the peptide side chains can be converted to $C_1$-$C_{16}$ alkoxy or to a $C_1$-$C_{16}$ ester using well-recognized techniques. Phenyl and phenolic rings of the peptide side chains can be substituted with one or more halogen atoms, such as F, Cl, Br or I, or with $C_1$-$C_{16}$ alkyl, $C_1$-$C_{16}$ alkoxy, carboxylic acids and esters thereof, or amides of such carboxylic acids. Methylene groups of the peptide side chains can be extended to homologous $C_2$-$C_4$ alkylenes. Thiols can be protected with any one of a number of well-recognized protecting groups, such as acetamide groups. Those skilled in the art will also recognize methods for introducing cyclic structures into the peptides of this disclosure to select and provide conformational constraints to the structure that result in enhanced stability. For example, a C- or N-terminal cysteine can be added to the peptide, so that when oxidized the peptide will contain a disulfide bond, generating a cyclic peptide. Other peptide cyclizing methods include the formation of thioethers and carboxyl- and amino-terminal amides and esters.

Prime-boost vaccination: An immunotherapy including administration of a first immunogenic composition (the primer vaccine) followed by administration of a second immunogenic composition (the booster vaccine) to a subject to induce an immune response. The primer vaccine and/or the booster vaccine include a vector (such as a viral vector, RNA, or DNA vector) expressing the antigen to which the immune response is directed. The booster vaccine is administered to the subject after the primer vaccine; the skilled artisan will understand a suitable time interval between administration of the primer vaccine and the booster vaccine, and examples of such timeframes are disclosed herein. In some embodiments, the primer vaccine, the booster vaccine, or both primer vaccine and the booster vaccine additionally include an adjuvant. In one non-limiting example, the primer vaccine is a DNA-based vaccine (or other vaccine based on gene delivery), and the booster vaccine is a protein subunit or protein nanoparticle based vaccine.

Protein nanoparticle: A multi-subunit, protein-based polyhedron shaped structure. The subunits are each composed of proteins or polypeptides (for example a glycosylated polypeptide), and, optionally of single or multiple features of the following: nucleic acids, prosthetic groups, organic and inorganic compounds. Non-limiting examples of protein nanoparticles include ferritin nanoparticles (see, e.g., Zhang, Y. Int. J. Mol. Sci., 12:5406-5421, 2011, incorporated by reference herein), encapsulin nanoparticles (see, e.g., Sutter et al., Nature Struct. and Mol. Biol., 15:939-947, 2008, incorporated by reference herein), Sulfur Oxygenase Reductase (SOR) nanoparticles (see, e.g., Urich et al., Science, 311:996-1000, 2006, incorporated by reference herein), lumazine synthase nanoparticles (see, e.g., Zhang et al., J. Mol. Biol., 306: 1099-1114, 2001) or pyruvate dehydrogenase nanoparticles (see, e.g., Izard et al., PNAS 96: 1240-1245, 1999, incorporated by reference herein). Ferritin, encapsulin, SOR, lumazine synthase, and pyruvate dehydrogenase are monomeric proteins that self-assemble into a globular protein complexes that in some cases consists of 24, 60, 24, 60, and 60 protein subunits, respectively. In some examples, ferritin, encapsulin, SOR, lumazine synthase, or pyruvate dehydrogenase monomers are linked to a recombinant HIV-1 Env ectodomain and self-assemble into a protein nanoparticle presenting the recombinant HIV-1 Env ectodomain on its surface, which can be administered to a subject to stimulate an immune response to the antigen.

Recombinant: A recombinant nucleic acid is one that has a sequence that is not naturally occurring or has a sequence that is made by an artificial combination of two otherwise separated segments of sequence. This artificial combination can be accomplished, for example, the artificial manipulation of isolated segments of nucleic acids, for example using genetic engineering techniques. A recombinant protein is one that has a sequence that is not naturally occurring or has a sequence that is made by an artificial combination of two otherwise separated segments of sequence. In several embodiments, a recombinant protein is encoded by a heterologous (for example, recombinant) nucleic acid that has been introduced into a host cell, such as a bacterial or eukaryotic cell. The nucleic acid can be introduced, for example, on an expression vector having signals capable of expressing the protein encoded by the introduced nucleic acid or the nucleic acid can be integrated into the host cell chromosome.

Root mean square deviation (RMSD): The square root of the arithmetic mean of the squares of the deviations from the mean. In several embodiments, RMSD is used as a way of expressing deviation or variation from the structural coordinates of a reference three dimensional structure. This number is typically calculated after optimal superposition of two structures, as the square root of the mean square distances between equivalent $C_\alpha$ atoms.

Sample (or biological sample): A biological specimen containing genomic DNA, RNA (including mRNA), protein, or combinations thereof, obtained from a subject. Examples include, but are not limited to, peripheral blood, tissue, cells, urine, saliva, tissue biopsy, fine needle aspirate, surgical specimen, and autopsy material.

Sequence identity: The similarity between amino acid sequences is expressed in terms of the similarity between the sequences, otherwise referred to as sequence identity. Sequence identity is frequently measured in terms of percentage identity (or similarity or homology); the higher the percentage, the more similar the two sequences are. Homologs, orthologs, or variants of a polypeptide will possess a relatively high degree of sequence identity when aligned using standard methods.

Methods of alignment of sequences for comparison are well known in the art. Various programs and alignment algorithms are described in: Smith & Waterman, *Adv. Appl. Math.* 2:482, 1981; Needleman & Wunsch, *J. Mol. Biol.* 48:443, 1970; Pearson & Lipman, *Proc. Natl. Acad. Sci. USA* 85:2444, 1988; Higgins & Sharp, *Gene,* 73:237-44, 1988; Higgins & Sharp, *CABIOS* 5:151-3, 1989; Corpet et al., *Nuc. Acids Res.* 16:10881-90, 1988; Huang et al. *Computer Appls. in the Biosciences* 8, 155-65, 1992; and Pearson et al., *Meth. Mol. Bio.* 24:307-31, 1994. Altschul et al., *J. Mol. Biol.* 215:403-10, 1990, presents a detailed consideration of sequence alignment methods and homology calculations.

Once aligned, the number of matches is determined by counting the number of positions where an identical nucleotide or amino acid residue is present in both sequences. The percent sequence identity is determined by dividing the number of matches either by the length of the sequence set forth in the identified sequence, or by an articulated length (such as 100 consecutive nucleotides or amino acid residues from a sequence set forth in an identified sequence), followed by multiplying the resulting value by 100. For example, a peptide sequence that has 1166 matches when aligned with a test sequence having 1554 amino acids is 75.0 percent identical to the test sequence (1166÷1554*100=75.0). The percent sequence identity value is rounded to the nearest tenth. For example, 75.11, 75.12, 75.13, and 75.14 are rounded down to 75.1, while 75.15, 75.16, 75.17, 75.18, and 75.19 are rounded up to 75.2. The length value will always be an integer.

Homologs and variants of a polypeptide are typically characterized by possession of at least about 75%, for example at least about 80%, 85%, 90%, 91%, 92%, 93%, 94%, 95%, 96%, 97%, 98% or 99% sequence identity counted over the full length alignment with the amino acid sequence of interest. Proteins with even greater similarity to the reference sequences will show increasing percentage identities when assessed by this method, such as at least 80%, at least 85%, at least 90%, at least 95%, at least 98%, or at least 99% sequence identity. When less than the entire sequence is being compared for sequence identity, homologs and variants will typically possess at least 80% sequence identity over short windows of 10-20 amino acids, and may possess sequence identities of at least 85% or at least 90% or 95% depending on their similarity to the reference sequence. Methods for determining sequence identity over such short windows are available at the NCBI website on the internet. One of skill in the art will appreciate that these sequence identity ranges are provided for guidance only; it is entirely possible that strongly significant homologs could be obtained that fall outside of the ranges provided.

For sequence comparison of nucleic acid sequences, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters are used. Methods of alignment of sequences for comparison are well known in the art. Optimal alignment of sequences for comparison can be conducted, e.g., by the local homology algorithm of Smith & Waterman, *Adv. Appl. Math.* 2:482, 1981, by the homology alignment algorithm of Needleman & Wunsch, *J. Mol. Biol.* 48:443, 1970, by the search for similarity method of Pearson & Lipman, *Proc. Natl. Acad. Sci. USA* 85:2444, 1988, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Sambrook et al. (Molecular Cloning: A Laboratory Manual, 4$^{th}$ ed, Cold Spring Harbor, N.Y., 2012) and Ausubel et al. (In Current Protocols in Molecular Biology, John Wiley & Sons, New York, through supplement 104, 2013). One example of a useful algorithm is PILEUP. PILEUP uses a simplification of the progressive alignment method of Feng & Doolittle, *J. Mol. Evol.* 35:351-360, 1987. The method used is similar to the method described by Higgins & Sharp, *CABIOS* 5:151-153, 1989. Using PILEUP, a reference sequence is compared to other test sequences to determine the percent sequence identity relationship using the following parameters: default gap weight (3.00), default gap length weight (0.10), and weighted end gaps. PILEUP can be obtained from the GCG sequence analysis software package, e.g., version 7.0 (Devereaux et al., *Nuc. Acids Res.* 12:387-395, 1984.

Another example of algorithms that are suitable for determining percent sequence identity and sequence similarity are the BLAST and the BLAST 2.0 algorithm, which are described in Altschul et al., *J. Mol. Biol.* 215:403-410, 1990 and Altschul et al., *Nucleic Acids Res.* 25:3389-3402, 1977. Software for performing BLAST analyses is publicly available through the National Center for Biotechnology Information (ncbi.nlm.nih.gov). The BLASTN program (for nucleotide sequences) uses as defaults a word length (W) of 11, alignments (B) of 50, expectation (E) of 10, M=5, N=−4, and a comparison of both strands. The BLASTP program (for amino acid sequences) uses as defaults a word length (W) of 3, and expectation (E) of 10, and the BLOSUM62 scoring matrix (see Henikoff & Henikoff, *Proc. Natl. Acad. Sci. USA* 89:10915, 1989). An oligonucleotide is a linear polynucleotide sequence of up to about 100 nucleotide bases in length.

As used herein, reference to "at least 80% identity" (or similar language) refers to "at least 80%, at least 85%, at least 90%, at least 91%, at least 92%, at least 93%, at least 94%, at least 95%, at least 96%, at least 97%, at least 98%, at least 99%, or even 100% identity" to a specified reference sequence. As used herein, reference to "at least 90% identity" (or similar language) refers to "at least 90%, at least 91%, at least 92%, at least 93%, at least 94%, at least 95%, at least 96%, at least 97%, at least 98%, at least 99%, or even 100% identity" to a specified reference sequence.

Single chain HIV-1 Env ectodomain: A recombinant polypeptide including gp120 and the gp41 ectodomain in a single polypeptide chain. Single chain HIV-1 Env ectodomains can trimerize to form a trimeric HIV-1 Env ectodomain. A single chain HIV-1 Env ectodomain does not include the furin cleavage site separating gp120 and gp41; therefore, when produced in cells, the Env ectodomain is not cleaved into separate gp120 and gp41 ectodomain polypeptides. For example, the gp120 and gp41 proteins can be linked by a peptide linker, or directly linked. In some embodiments, a single chain HIV-1 Env ectodomain includes a circular permuted HIV-1 Env ectodomain. Single chain HIV-1 Env ectodomains are of particular interest for DNA or vector encoded immunogens, as it can be beneficial in these immunogen format to not need to rely on the presence of furin (or furin-like) protease in a host cell for maturation of separate gp120/gp41 polypeptides.

Signal Peptide: A short amino acid sequence (e.g., approximately 18-25 amino acids in length) that directs newly synthesized secretory or membrane proteins to and through membranes (for example, the endoplasmic reticulum membrane). Signal peptides are typically located at the N-terminus of a polypeptide and are removed by signal peptidases after the polypeptide has crossed the membrane. Signal peptide sequences typically contain three common structural features: an N-terminal polar basic region (n-region), a hydrophobic core, and a hydrophilic c-region). Exemplary signal peptide sequences are set forth as residues 1-30 of SEQ ID NO: 1 (HXB2 Env signal peptide) and SEQ ID NO: 2 (BG505 Env signal peptide).

Specifically bind: When referring to the formation of an antibody:antigen protein complex, or a protein:protein complex, refers to a binding reaction which determines the presence of a target protein, peptide, or polysaccharide (for example a glycoprotein), in the presence of a heterogeneous population of proteins and other biologics. Thus, under designated conditions, an particular antibody or protein binds preferentially to a particular target protein, peptide or polysaccharide (such as an antigen present on the surface of a pathogen, for example gp120) and does not bind in a significant amount to other proteins or polysaccharides present in the sample or subject. Specific binding can be determined by methods known in the art. A first protein or antibody specifically binds to a target protein when the interaction has a $K_D$ of less than $10^{-6}$ Molar, such as less than $10^{-7}$ Molar, less than $10^{-8}$ Molar, less than $10^{-9}$, or even less than $10^{-10}$ Molar. In some embodiments, an antibody does not specifically bind to a disclosed recombinant HIV-1 Env ectodomain trimer if the binding interaction of the antibody to trimer has a $K_D$ of more than $10^{-6}$ when assayed at stoichiometry of at least one antibody Fab per protomer in the trimer.

Subject: Living multi-cellular vertebrate organisms, a category that includes human and non-human mammals. In an example, a subject is a human. In a particular example, the subject is a newborn infant. In an additional example, a subject is selected that is in need of inhibiting of an HIV infection. For example, the subject is either uninfected and at risk of HIV infection or is infected in need of treatment.

T Cell: A white blood cell critical to the immune response. T cells include, but are not limited to, $CD4^+$ T cells and $CD8^+$ T cells. A $CD4^+$ T lymphocyte is an immune cell that expresses CD4 on its surface. These cells, also known as helper T cells, help orchestrate the immune response, including antibody responses as well as killer T cell responses. Th1 and Th2 cells are functional subsets of helper T cells. Th1 cells secrete a set of cytokines, including interferon-gamma, and whose principal function is to stimulate phagocyte-mediated defense against infections, especially related to intracellular microbes. Th2 cells secrete a set of cytokines, including interleukin (IL)-4 and IL-5, and whose principal functions are to stimulate IgE and eosinophil/mast cell-mediated immune reactions and to downregulate Th1 responses.

Therapeutically effective amount: The amount of agent, such as a disclosed immunogen or immunogenic composition that is sufficient to prevent, treat (including prophylaxis), reduce and/or ameliorate the symptoms and/or underlying causes of a disorder or disease, for example to prevent, inhibit, and/or treat HIV-1 infection. In some embodiments, a therapeutically effective amount is sufficient to reduce or eliminate a symptom of a disease, such as HIV-1 infection. For instance, this can be the amount necessary to inhibit or prevent viral replication or to measurably alter outward symptoms of the viral infection. In general, this amount will be sufficient to measurably inhibit virus replication or infectivity.

In one example, a desired response is to inhibit or reduce or prevent HIV infection. The HIV infected cells do not need to be completely eliminated or reduced or prevented for the composition to be effective. For example, administration of a therapeutically effective amount of the agent can decrease the number of HIV infected cells (or prevent the infection of cells) by a desired amount, for example by at least 50%, at least 60%, at least 70%, at least 80%, at least 90%, at least 95%, at least 98%, or even at least 100% (elimination or prevention of detectable HIV infected cells), as compared to the number of HIV infected cells in the absence of the composition.

It is understood that to obtain a protective immune response against a pathogen can require multiple administrations of the immunogenic composition. Thus, a therapeutically effective amount encompasses a fractional dose that contributes in combination with previous or subsequent administrations to attaining a protective immune response. For example, a therapeutically effective amount of an agent can be administered in a single dose, or in several doses, for example daily, during a course of treatment (such as a prime-boost vaccination treatment). However, the therapeutically effective amount can depend on the subject being treated, the severity and type of the condition being treated, and the manner of administration. A unit dosage form of the agent can be packaged in a therapeutic amount, or in multiples of the therapeutic amount, for example, in a vial (e.g., with a pierceable lid) or syringe having sterile components.

Transmembrane domain: An amino acid sequence that inserts into a lipid bilayer, such as the lipid bilayer of a cell or virus or virus-like particle. A transmembrane domain can be used to anchor an antigen to a membrane. In some examples a transmembrane domain is a HIV-1 Env transmembrane domain. Exemplary HIV-1 Env transmembrane domains are familiar to the person of ordinary skill in the art, and provided herein, for example as SEQ ID NOs: 758, 760, and 762.

Treating or preventing a disease: Inhibiting the full development of a disease or condition, for example, in a subject who is at risk for a disease such as HIV-1 infection or acquired immunodeficiency syndrome (AIDS). "Treatment" refers to a therapeutic intervention that ameliorates a sign or symptom of a disease or pathological condition after it has begun to develop. The term "ameliorating," with reference to a disease or pathological condition, refers to any observable beneficial effect of the treatment. The beneficial effect can be evidenced, for example, by a delayed onset of clinical symptoms of the disease in a susceptible subject, a reduction in severity of some or all clinical symptoms of the disease, a slower progression of the disease, a reduction in the viral load, an improvement in the overall health or well-being of the subject, or by other parameters well known in the art that are specific to the particular disease. A "prophylactic" treatment is a treatment administered to a subject who does not exhibit signs of a disease or exhibits only early signs for the purpose of decreasing the risk of developing pathology.

The term "reduces" is a relative term, such that an agent reduces a response or condition if the response or condition is quantitatively diminished following administration of the agent, or if it is diminished following administration of the agent, as compared to a reference agent. Similarly, the term "prevents" does not necessarily mean that an agent completely eliminates the response or condition, so long as at least one characteristic of the response or condition is eliminated. Thus, an immunogenic composition that reduces or prevents an infection or a response, can, but does not necessarily completely, eliminate such an infection or response, so long as the infection or response is measurably diminished, for example, by at least about 50%, such as by at least about 70%, or about 80%, or even by about 90% of (that is to 10% or less than) the infection or response in the absence of the agent, or in comparison to a reference agent.

Tyrosine Sulfation: Addition of a sulfate group to a tyrosine residue in a protein. In cells, tyrosine sulfation is a post translational modification where a sulfate group is added to a tyrosine residue of a protein molecule in the Golgi or endoplasmic reticulum. Tyrosine sulfation can be catalyzed by a tyrosyl-protein sulfotransferase (TPST), such as TPST1 or TPST2. The reaction catalyzed by TPST is a transfer of sulfate from the universal sulfate donor 3'-phosphoadenosine-5'-phosphosulfate (PAPS) to the side-chain hydroxyl group of a tyrosine residue. Tyrosine sulfation can also be accomplished in vitro, for example by incubating a peptide containing one or more tyrosine residues with a TBST enzyme (such as TBST1 or TBST2) under appropriate conditions. Methods of sulfating a tyrosine residue on a protein are known (see, e.g., U.S. Pat. No. 5,541,095, 2009/0042738, 2006/0009631, 2003/0170849, 2006/0115859, Liu et al., Mol. Biosyst., 7:38-47, 2011, and Choe and Farzan, Methods in Enzymology, 461: 147-170, 2009) each of which is incorporated by reference herein).

Under conditions sufficient for: A phrase that is used to describe any environment that permits a desired activity.

Vaccine: A pharmaceutical composition that elicits a prophylactic or therapeutic immune response in a subject. In some cases, the immune response is a protective immune response. Typically, a vaccine elicits an antigen-specific immune response to an antigen of a pathogen, for example a viral pathogen, or to a cellular constituent correlated with a pathological condition. A vaccine may include a polynucleotide (such as a nucleic acid encoding a disclosed antigen), a peptide or polypeptide (such as a disclosed antigen), a virus, a cell or one or more cellular constituents. In one specific, non-limiting example, a vaccine reduces the severity of the symptoms associated with HIV infection and/or decreases the viral load compared to a control. In another non-limiting example, a vaccine reduces HIV-1 infection compared to a control.

Vector: A nucleic acid molecule as introduced into a host cell, thereby producing a transformed host cell. Recombinant DNA vectors are vectors having recombinant DNA. A vector can include nucleic acid sequences that permit it to replicate in a host cell, such as an origin of replication. A vector can also include one or more selectable marker genes and other genetic elements known in the art. Viral vectors are recombinant nucleic acid vectors having at least some nucleic acid sequences derived from one or more viruses. A replication deficient viral vector is a vector that requires complementation of one or more regions of the viral genome required for replication due to a deficiency in at least one replication-essential gene function. For example, such that the viral vector does not replicate in typical host cells, especially those in a human patient that could be infected by the viral vector in the course of a therapeutic method.

Virus-like particle (VLP): A non-replicating, viral shell, derived from any of several viruses. VLPs are generally composed of one or more viral proteins, such as, but not limited to, those proteins referred to as capsid, coat, shell, surface and/or envelope proteins, or particle-forming polypeptides derived from these proteins. VLPs can form spontaneously upon recombinant expression of the protein in an appropriate expression system. Methods for producing particular VLPs are known in the art. The presence of VLPs following recombinant expression of viral proteins can be detected using conventional techniques known in the art, such as by electron microscopy, biophysical characterization, and the like. Further, VLPs can be isolated by known techniques, e.g., density gradient centrifugation and identified by characteristic density banding. See, for example, Baker et al. (1991) *Biophys. J.* 60:1445-1456; and Hagensee et al. (1994) *J. Virol.* 68:4503-4505; Vincente, *J Invertebr Pathol.*, 2011; Schneider-Ohrum and Ross, *Curr. Top. Microbiol. Immunol.*, 354: 53073, 2012).

VRC01: A neutralizing monoclonal antibody that specifically binds to the CD4 binding site on HIV-1 Env and can inhibit HIV-1 infection of target cells. The person of ordinary skill in the art is familiar with the VRC01 mAb and with methods of its use and production (see, for example, Wu et al., *Science*, 329(5993):856-861, 2010, and PCT publication WO2012/154312, each of which is incorporated by reference herein). The amino acid sequences of the heavy and light variable regions of the VRC01 mAb are known and have been deposited in GenBank as Nos. ADF47181.1 (VRC01 $V_H$) and ADF47184.1 (VRC01 $V_L$), each of which is incorporated by reference herein as present in the database on Jun. 20, 2014)

VRC26: A neutralizing monoclonal antibody that specifically binds to the V1/V2 domain of HIV-1 Env trimer in its prefusion mature closed conformation, and which can inhibit HIV-1 infection of target cells. As used herein, "VRC26" refers to the VRC26.09 antibody, which is one of several clonal variants isolated from donor CAP256. The person of ordinary skill in the art is familiar with the VRC26.09 mAb and with methods of its use and production (see, for example, Doria-Rose et al., Nature, 509, 55-62, 2014, which is incorporated by reference herein). The amino acid sequences of the heavy and light variable regions of the VRC26 mAb are known and have been deposited in GenBank as Nos. KJ134874 (VRC26.09 $V_H$) and KJ134886 (VRC26.09 $V_L$), each of which is incorporated by reference herein as present in the database on Jun. 20, 2014).

II. Description of Several Embodiments

A. Native HIV-1 Sequences

HIV can be classified into four groups: the "major" group M, the "outlier" group O, group N, and group P. Within group M, there are several genetically distinct clades (or subtypes) of HIV-1. The disclosed recombinant HIV-1 Env proteins can be derived from any type of HIV, such as groups M, N, O, or P, or clade, such as clade A, B, C, D, F, G, H, J, or K, and the like. HIV-1 Env proteins from the different HIV clades, as well as nucleic acid sequences encoding such proteins and methods for the manipulation and insertion of such nucleic acid sequences into vectors, are known (see, e.g., HIV Sequence Compendium, Division of AIDS, National Institute of Allergy and Infectious Diseases (2013); HIV Sequence Database (hiv-web.lanl.gov/content/hiv-db/mainpage.html); see, e.g., Sambrook et al. (Molecular Cloning: A Laboratory Manual, 4th ed, Cold Spring Harbor, N.Y., 2012) and Ausubel et al. (In Current Protocols in Molecular Biology, John Wiley & Sons, New York, through supplement 104, 2013). Exemplary native HIV-1 Env protein sequences are available in the HIV Sequence Database (hiv-web.lanl.gov/content/hiv-db/mainpage.html), further, Table 5 provides sequences for Exemplary native HIV-1 Env proteins.

TABLE 5

Exemplary Native HIV-1 Env sequences

| Strain | Clade | Env sequence |
|---|---|---|
| HXB2 | B | SEQ ID NO: 1 |
| BG505 | A | SEQ ID NO: 2 |
| CAP256.SU | C | SEQ ID NO: 51 |
| BB201.B42 | A | SEQ ID NO: 81 |
| KER2018.11 | A | SEQ ID NO: 107 |
| CH070.1 | BC | SEQ ID NO: 174 |
| ZM233.6 | C | SEQ ID NO: 745 |
| Q23.17 | A | SEQ ID NO: 746 |
| A244 | AE | SEQ ID NO: 747 |
| WITO.33 | B | SEQ ID NO: 748 |
| ZM53.12 | C | SEQ ID NO: 749 |
| CNE58 | C | SEQ ID NO: 750 |
| 3301_V1_C24 | AC | SEQ ID NO: 751 |
| T250-4 | AE | SEQ ID NO: 2114 |
| JRFL | B | SEQ ID NO: 2115 |

In several embodiments, a disclosed immunogen can include a modification (e.g., cysteine substitutions that can form a disulfide bond to stabilize the HIV1 Env protein in a prefusion closed mature conformation) from a native HIV-1 Env protein sequence that has been determined to produce broadly neutralizing antibodies in a human subject, for example broadly neutralizing antibodies that specifically bind the V1V2 domain of HIV-1 Env. For example, in some embodiments, an HIV-1 Env (or fragment thereof) sequence from a CAP256.SU, BB201.B42, KER2018.11, CH070.1, ZM233.6, Q23.17, A244, T250-4, or WITO.33 strain of HIV-1 is mutated to include one or more of the disclosed amino acid substitutions to generate a recombinant HIV Env protein (or fragment thereof, such as a gp140 or gp145 protein) that is stabilized in a prefusion mature closed conformation. For example, in some non-limiting embodiments, cysteine substitutions at positions 201 and 433, and the SOSIP mutations, are made to a gp140 sequence from a CAP256.SU, BB201.B42, KER2018.11, CH070.1, ZM233.6, Q23.17, A244, T250-4, or WITO.33 strain of HIV-1 to generate the recombinant HIV-1 Env ectodomain that can form a trimer stabilized in the prefusion mature closed conformation.

In view of the conservation and breadth of knowledge of HIV-1 Env sequences, the person of ordinary skill in the art can easily identify corresponding HIV-1 Env amino acid positions between different HIV-1 Env strains and subtypes. The HXB2 numbering system has been developed to assist comparison between different HIV amino acid and nucleic acid sequences. The person of ordinary skill in the art is familiar with the HXB2 numbering system (see, e.g., Korber et al., Human Retroviruses and AIDS 1998: A Compilation and Analysis of Nucleic Acid and Amino Acid Sequences. Korber B, Kuiken C L, Foley B, Hahn B, McCutchan F, Mellors J W, and Sodroski J, Eds. Theoretical Biology and Biophysics Group, Los Alamos National Laboratory, Los Alamos, N. Mex., which is incorporated by reference herein in its entirety). The numbering of amino acid substitutions disclosed herein is made according to the HXB2 numbering system, unless context indicates otherwise.

B. Recombinant HIV-1 Env Ectodomains Stabilized in a Prefusion Mature Closed Conformation Isolated immunogens are disclosed herein that include a recombinant HIV-1 Env ectodomain trimer or immunogenic fragment thereof that is modified from a native form (e.g., by introduction of one or more amino acid substitutions) to be stabilized in the prefusion mature closed conformation.

The HIV-1 Env ectodomain trimer can include a prefusion mature closed conformation wherein the V1V2 domain of each Env ectodomain protomer in the trimer comes together at the membrane distal apex. At the membrane proximal aspect, the HIV-1 Env ectodomain trimer in the prefusion mature closed conformation includes distinct $\alpha 6$ and $\alpha 7$ helices; the $\alpha 7$ helix does not start until after residue 570. For example, in the prefusion mature closed conformation, the interprotomer distance between residues 200 and 313 can be less than 5 Angstroms.

In several embodiments, the immunogen includes a recombinant HIV-1 Env ectodomain trimer, which can include, for example, a trimeric complex of recombinant HIV-1 Env ectodomains that are stabilized in the prefusion mature closed conformation by one or more amino acid substitutions. The recombinant HIV-1 Env ectodomain trimer typically includes a protein complex of gp120-gp41 ectodomain protomers. The gp120-gp41 protomer can include separate gp120 and gp41 polypeptide chains, or can include gp120 and gp41 polypeptide chains that are linked (e.g., by a peptide linker) to form a single polypeptide chain (e.g., as described in the "single chain" section below). In several embodiments, the recombinant HIV-1 Env ectodomain trimer is membrane anchored and can include a trimeric complex of recombinant HIV-1 Env ectodomains that are linked to a transmembrane domain (e.g., a gp145 protein including a gp120 protein and a gp41 ectodomain and transmembrane domain).

The recombinant HIV-1 Env ectodomain includes a gp120 protein and a gp41 ectodomain. The gp120 protein typically does not include a signal peptide (for example, the gp120 protein typically does not include gp120 residues 1-30), as the signal peptide is proteolytically cleaved during cellular processing. Additionally, the gp41 ectodomain includes the extracellular portion of gp41 (e.g., positions 512-664). In embodiments including a soluble recombinant HIV-1 Env ectodomain, the gp41 ectodomain is not linked to a transmembrane domain or other membrane anchor. However, in embodiments including a membrane anchored recombinant HIV-1 Env ectodomain the gp41 ectodomain can be linked to a transmembrane domain (such as, but not limited to, an HIV-1 Env transmembrane domain).

In several embodiments, the recombinant HIV-1 Env ectodomain includes a gp120 polypeptide and a gp41 ectodomain, wherein the n-terminal residue of the gp120 polypeptide is one of HIV-1 Env positions 1-35;

the c-terminal residue of the gp120 polypeptide is one of HIV-1 Env positions 503-511;

the n-terminal residue of the gp41 ectodomain is one of HIV-1 Env positions 512-522; and/or the c-terminal residue of the gp41 ectodomain is one of HIV-1 Env positions 624-705.

In one non-limiting example, the recombinant HIV-1 Env ectodomain includes a gp120 polypeptide and a gp41 ectodomain, wherein the n-terminal residue of the gp120 polypeptide is HIV-1 Env position 31; the c-terminal residue of the gp120 polypeptide is HIV-1 Env position 511; the n-terminal residue of the gp41 polypeptide is HIV-1 Env position 512; and/or the c-terminal residue of the gp41 polypeptide is HIV-1 Env position 664. In some embodiments, the C-terminal residue of the recombinant HIV-1 Env ectodomain is position 683 (the entire ectodomain, terminating just before the transmembrane domain). In additional embodiments, the C-terminal residue of the recombinant HIV-1 Env ectodomain is position 707 (the entire ectodomain, terminating just after the transmembrane domain).

Native HIV-1 Env sequences include a furin cleavage site (e.g., REKR, SEQ ID NO: 572) between positions 508 and 512 (HXB2 numbering), that separates gp120 and gp41. Any of the disclosed recombinant HIV-1 Env ectodomains can further include an enhanced cleavage site between gp120 and gp41 proteins. The enhanced cleavage cite can include, for example, substitution of six arginine resides for the four residues of the native cleavage site (e.g., REKR (SEQ ID NO: 572) to RRRRRR (SEQ ID NO: 573). As used herein, reference to "R6" indicates that a HIV Env protein includes the RRRRRR (SEQ ID NO: 573) substitution for the native furin cleavage site. It will be understood that protease cleavage of the furin or enhanced cleavage site separating gp120 and gp41 can remove a few amino acids from either end of the cleavage site.

Stabilization of the recombinant HIV-1 Env ectodomain trimer or immunogenic fragment in the prefusion mature closed conformation prevents transition of the HIV-1 Env ectodomain to the CD-bound open conformation. Thus, the disclosed recombinant HIV-1 Env ectodomain trimers can be specifically bound by an antibody that is specific for the mature closed conformation of HIV-1 Env (e.g., VRC26, PGT151, PGT122, or PGT145), but are not specifically bound by an antibody specific for the CD4-bound open conformation, of HIV-1 Env (e.g., 17b mAb in the presence of sCD4). In one example, the recombinant HIV-1 Env ectodomain trimer is not specifically bound by an antibody specific for a CD4-induced epitope on the recombinant HIV-1 Env ectodomain trimer, such as the 17b antibody. Methods of determining if a recombinant HIV-1 Env ectodomain trimer includes a CD4-induced epitope are known in the art and disclosed herein (See Examples 1 and 2). For example, the antibody binding assay can be conducted in the presence of a molar excess of soluble CD4 as described in Sanders et al. (*Plos Pathogens*, 9, e1003618, 2013).

In several embodiments, the recombinant HIV-1 Env ectodomain trimers can be specifically bound by an antibody that specifically binds to the V1V2 domain on a HIV-1 Env trimer, but not an Env monomer. Exemplary antibodies with such antigen binding characteristics include the PGT141, PGT142, PGT143, PGT144, PGT145, and VRC26 antibodies. Additional examples include the PG9, PG16, and CH01-CH04 antibodies. Accordingly, in some embodiments the recombinant HIV-1 Env ectodomain trimer specifically binds to an antibody (such as a PGT141, PGT142, PGT143, PGT144, PGT145, and VRC26 antibody) that specifically binds to the V1V2 domain of a HIV-1 Env in its trimeric, but not monomeric, form with a dissociation constant of less than $10^{-6}$ Molar, such as less than $10^{-7}$ Molar, less than $10^{-8}$ Molar, or less than $10^{-9}$ Molar. Specific binding can be determined by methods known in the art. The determination of specific binding may readily be made by using or adapting routine procedures, such as ELISA, immunocompetition, surface plasmon resonance, or other immunosorbant assays (described in many standard texts, including Harlow and Lane, *Using Antibodies: A Laboratory Manual*, CSHL, New York, 1999).

The recombinant HIV-1 Env ectodomain trimers or immunogenic fragments are stabilized in the prefusion mature closed conformation by one or more amino acid substitutions. Thus, the recombinant HIV-1 Env ectodomain trimers or immunogenic fragments are not stabilized by non-specific crosslinking, for example glutaraldehyde crosslinking of membrane bound HIV-1 Env trimers.

In several embodiments, the recombinant HIV-1 Env ectodomain trimer is soluble in aqueous solution. In some embodiments, the recombinant HIV-1 Env ectodomain trimer dissolves to a concentration of at least 0.5 mg/ml (such as at least 1.0 mg/ml, 1.5 mg/ml, 2.0 mg/ml, 3.0 mg/ml, 4.0 mg/ml or at least 5.0 mg/ml) in phosphate buffered saline (pH 7.4) at room temperature (e.g., 20-22 degrees Celsius) and remains dissolved for at least for at least 12 hours (such as at least 24 hours, at least 48 hours, at least one week, at least two weeks, or more time). In one embodiment, the phosphate buffered saline includes NaCl (137 mM), KCl (2.7 mM), $Na_2HPO_4$ (10 mM), $KH_2PO_4$ (1.8 mM) at pH 7.4. In some embodiments, the phosphate buffered saline further includes $CaCl_2$ (1 mM) and $MgCl_2$ (0.5 mM). The person of skill in the art is familiar with methods of determining if a protein remains in solution over time. For example, the concentration of the protein dissolved in an aqueous solution can be tested over time using standard methods.

In some embodiments, the recombinant HIV-1 Env ectodomain trimer, when incubated in an aqueous solution, forms a population of recombinant HIV-1 Env ectodomain trimers stabilized in a prefusion mature closed conformation, wherein at least 70% (such as at least 80%, or at least 90% or at least 95% or at least 98%) of the recombinant HIV-1 Env ectodomain trimers in the population specifically bind to an antibody that specifically binds to the V1V2 domain of a trimer, but not monomeric HIV-1 Env (such as a PGT141, PGT142, PGT143, PGT144, PGT145, and VRC26 antibody) after (a) incubation for one hour in 350 mM NaCl pH 7.0, at 50° C.;

(b) incubation for one hour in 350 mM NaCl pH 3.5, at 25° C.;

(c) incubation for one hour in 350 mM NaCl pH 10, at 25° C.;

(d) incubation for one hour in 10 mM osmolarity, pH 7.0, at 25° C.;

(e) incubation for one hour in 3000 mM osmolarity, pH 7.0, at 25° C.;

(g) a combination of two or more of (a)-(e); or a combination of (a) and (b); (a) and (c); (a) and (d); (a) and (e); (b) and (d); (b) and (e); (c) and (d); (c) and (e); (a), (b), and (d); (a), (c), and (d); (a), (b), and (e); or (a), (c), and (e).

In some embodiments, the recombinant HIV-1 Env ectodomain trimer, when incubated in an aqueous solution, forms a population of recombinant HIV-1 Env ectodomain trimers stabilized in a prefusion mature closed conformation, wherein at least 70% (such as at least 80%, or at least 90% or at least 95% or at least 98%) of the recombinant HIV-1 Env ectodomain trimers in the population specifically bind to an antibody that specifically binds to the V1V2 domain of a trimer, but not monomeric HIV-1 Env (such as a PGT141, PGT142, PGT143, PGT144, PGT145, and VRC26 antibody) ten freeze-thaw cycles in 350 mM NaCl pH 7.0.

Several embodiments include a multimer of the recombinant HIV-1 Env ectodomain trimer or immunogenic fragment thereof, for example, a multimer including 2, 3, 4, 5, 6, 7, 8, 9, or 10, or more of the recombinant HIV-1 Env ectodomain trimers or immunogenic fragment thereof.

It is understood in the art that some variations can be made in the amino acid sequence of a protein without affecting the activity of the protein. Such variations include insertion of amino acid residues, deletions of amino acid residues, and substitutions of amino acid residues. These variations in sequence can be naturally occurring variations or they can be engineered through the use of genetic engineering technique known to those skilled in the art.

Examples of such techniques are found in see, e.g., Sambrook et al. (Molecular Cloning: A Laboratory Manual, 4$^{th}$ ed, Cold Spring Harbor, N.Y., 2012) and Ausubel et al. (In Current Protocols in Molecular Biology, John Wiley & Sons, New York, through supplement 104, 2013, both of which are incorporated herein by reference in their entirety.

The recombinant HIV-1 Env ectodomain can include modifications of the native HIV-1 sequence, such as amino acid substitutions, deletions or insertions, glycosylation and/ or covalent linkage to unrelated proteins (e.g., a protein tag), as long as the recombinant HIV-1 Env ectodomain can form a trimer that is stabilized in the prefusion mature closed conformation. HIV-1 Env proteins from the different Clades, as well as nucleic acid sequences encoding such proteins and methods for the manipulation and insertion of such nucleic acid sequences into vectors, are disclosed herein and known in the art.

In some embodiments a recombinant HIV-1 Env ectodomain included in the disclosed trimers includes a gp120 polypeptide and a gp41 ectodomain including amino acid sequences at least 75% (for example at least 85%, 90%, 95%, 96%, 97%, 98% or 99%) sequence identity to a corresponding native HIV-1 gp120 or gp41 ectodomain polypeptide sequence (e.g., a native gp120 or gp41 ectodomain protein sequence from a clade A, B, C, D, F, G, H, J or K HIV-1 Env protein), such a native HIV-1 sequence available in the HIV Sequence Database (hiv-web.lanl.gov/ content/hiv-db/mainpage.html) or a native HIV-1 Env polypeptide sequence set forth in Table 5, and include the one or more amino acid substitutions that stabilize the protein in the prefusion mature closed conformation.

In additional embodiments, a recombinant HIV-1 Env ectodomain included in the disclosed trimers includes a gp120 polypeptide and/or a gp41 ectodomain including one or more amino acid substitutions compared to a corresponding native HIV-1 Env sequence. For example, in some embodiments, the gp120 polypeptide, gp41 ectodomain, or both, can include up to 20 (such as up to 1, 2, 3, 4, 5, 6, 7, 8, 9, 10, 11, 12, 13, 14, 15, 16, 17, 18, or 19) amino acid substitutions compared to a native HIV-1 gp140 polypeptide sequence (e.g., a native gp120 or gp41 ectodomain protein sequence from a clade A, B, C, D, F, G, H, J or K HIV-1 Env protein), such a native HIV-1 sequence available in the HIV Sequence Database (hiv-web.lanl.gov/content/hiv-db/mainpage.html) or a native HIV-1 Env polypeptide sequence set forth in Table 5, and include the one or more amino acid substitutions that stabilize the protein in the prefusion mature closed conformation. The simplest modifications involve the substitution of one or more amino acids for amino acids having similar biochemical properties. These so-called conservative substitutions are likely to have minimal impact on the activity of the resultant protein.

The recombinant HIV-1 Env ectodomain included in the disclosed trimers can be derivatized or linked to another molecule (such as another peptide or protein). In general, the recombinant HIV-1 Env ectodomain is derivatized such that the binding to broadly neutralizing antibodies to a trimer of the recombinant HIV-1 ectodomain, such as PGT122, is not affected adversely by the derivatization or labeling. For example, the recombinant HIV-1 Env ectodomain can be functionally linked (by chemical coupling, genetic fusion, noncovalent association or otherwise) to one or more other molecular entities, such as an antibody or protein or detection tag.

The stabilizing modifications provided herein are targeted modifications that stabilize the recombinant HIV-1 Env ectodomain trimer in the prefusion mature closed conformation. Guided by the structural features identified in the prefusion mature closed conformation, several modes of stabilizing the HIV-1 Env ectodomain trimer in this conformation are available, including (but not limited to) amino acid substitutions that introduce one or more non-natural disulfide bonds, fill cavities within the HIV-1 ectodomain trimer, prevent structural rearrangements, introduce N-linked glycosylation sites, and combinations thereof. Corresponding mutations are discussed in more detail below:

Reference to Table 13

Several stabilizing mutations are provided that can be included on a HIV-1 ectodomain to generate a trimeric HIV-1 ectodomain stabilized in the prefusion mature closed conformation. These mutations include, but are not limited to, those provided in Table 13. In several embodiments, the recombinant HIV-1 Env ectodomain trimer includes a HIV-1 Env ectodomain including the amino acid substitutions set forth in any one row of column 5, column 6, or columns 5 and 6, of Table 13. In additional embodiments, the recombinant HIV-1 Env ectodomain trimer includes a HIV-1 Env ectodomain including an amino acid sequence at least 80% identical to any one of the modified HIV-1 Env Ectodomain sequences listed in Table 13. In further embodiments, the recombinant HIV-1 Env ectodomain trimer includes a HIV-1 Env ectodomain including the amino acid sequence of any one of the modified HIV-1 Env Ectodomain sequences listed in of Table 13

Some of the sequences of recombinant HIV-1 ectodomains provided herein include the sequence of protease cleavage sites (such as thrombin sites), protein tags (such as a His tag, a Strep Tag II, a Avi tag, etc.), signal peptides, that the person of ordinary skill in the art will understand would not be included in an isolated immunogen including a recombinant HIV-1 Env ectodomain immunogen. The person of ordinary skill in the art will recognize such sequences, and when appropriate, understand that these tags or protease cleavage sites are not included in a disclosed recombinant HIV-1 Env protein.

In some embodiments, the recombinant HIV-1 Env ectodomain trimer includes the SOSIP, R6, 664 and 201C/ 433C modifications, an asparagine at position 332, and the substitutions listed in column 6 of any one of the rows for SEQ ID NO: 1245-1367 or 1580-1610 of Table 13. In some embodiments, the recombinant HIV-1 Env ectodomain trimer includes the SOSIP, R6, and 664 substitutions, an asparagine at position 332, and the substitutions listed in column 6 of any one of the rows for SEQ ID NO: 1368-1399 or 1580-1610 of Table 13. In several such embodiments, the recombinant HIV-1 Env ectodomain trimer can be based on a JRFL or a BG505 strain of HIV-1. In some embodiments, the gp120/gp41 ectodomains in the recombinant HIV-1 Env ectodomain trimer can comprise an amino acid sequence set forth as any one of SEQ ID NO: 1245-1399 or 1580-1610, or a sequence at least 90% identical thereto.

In some embodiments, the recombinant HIV-1 Env ectodomain trimer includes the SOSIP, R6, 664, and 201C/ 433C substitutions, an asparagine at position 332, and is based on a strain of HIV-1 as listed in column 4 of any one of the rows for SEQ ID NO: 26, 1057-1077, 1400-1579 of Table 13. In some embodiments, the gp120/gp41 ectodomains in the recombinant HIV-1 Env ectodomain trimer can comprise an amino acid sequence set forth as any one of SEQ ID NO: 26, 1057-1077, 1400-1579, or a sequence at least 90% identical thereto.

Non-natural Disulfide Bonds

In several embodiments, the recombinant HIV-1 Env ectodomain trimer includes one or more non-natural disulfide bonds that stabilize the HIV-1 Env ectodomain trimer in the prefusion mature closed conformation. A non-natural disulfide bond is one that does not occur in a native HIV-1 Env protein, and is introduced by protein engineering (e.g., by including one or more substituted cysteine residues that form the non-natural disulfide bond). For example, in some embodiments, any of the disclosed recombinant HIV-1 Env ectodomain trimers can be stabilized in a prefusion mature closed conformation by any one of 1, 2, 3, 4, 5, 6, 7, 8, 9, or 10 non-natural disulfide bonds.

The cysteine residues that form the disulfide bond can be introduced into a native HIV-1 sequence by one or more amino acid substitutions. For example, in some embodiments, a single amino acid substitution introduces a cysteine that forms a disulfide bond with a cysteine residue present in the native HIV-1 sequence. Alternately, two cysteine residues can be introduced into a native HIV-1 Env ectodomain sequence to form the disulfide bond. The location of the cysteine (or cysteines) of the non-natural disulfide bond can be determined by the person of ordinary skill in the art using the disclosed structure of the HIV-1 ectodomain trimer in a prefusion mature closed conformation.

For example, the amino acid positions of the cysteines are typically within a sufficiently close distance for formation of a disulfide bond in the prefusion mature closed conformation of the HIV-1 Env protein trimer. Methods of using three-dimensional structure data to determine if two residues are within a sufficiently close distance to one another for disulfide bond formation are known (see, e.g., Peterson et al., *Protein engineering*, 12:535-548, 1999 and Dombkowski, *Bioinformatics*, 19:1852-1853, 3002 (disclosing DISULFIDE BY DESIGN™), each of which is incorporated by reference herein). Residues can be selected manually, based on the three dimensional structure of the HIV-1 Env trimer in a prefusion mature closed conformation provided herein, or a software, such as DISULFIDEBYDESIGN™, can be used. Without being bound by theory, ideal distances for formation of a disulfide bond are generally considered to be about ~5.6 Å for Cα-Cα distance, ~2.02 Å for Sγ-Sγ distance, and 3.5-4.25 Å for Cβ-Cβ distance (using the optimal rotomer). The person of ordinary skill in the art will appreciate that variations from these distances are included when selecting residues in a three dimensional structure that can be substituted for cysteines for introduction of a disulfide bond. For example, in some embodiments the selected residues have a Cα-Cα distance of less than 7.0 Å and/or a Cβ-Cβ distance of less than 4.7 Å. In some embodiments the selected residues have a Cα-Cα distance of from 2.0-8.0 Å and/or a Cβ-Cβ distance of from 2.0-5.5 Å. In several embodiments, the amino acid positions of the cysteines are within a sufficiently close distance for formation of a disulfide bond in the prefusion mature closed conformation, but not the CD4-bound open conformation of the HIV-1 Env protein.

For example, the person of ordinary skill in the art can determine the relative position of a particular amino acid between the prefusion mature closed and CD4-bound conformations of the HIV-1 Env ectodomain by comparing the prefusion mature closed structures disclosed in the Examples and the structural coordinates provided in Tables 1-4, with the previously identified CD4-bound conformation described in Example 1. Methods of determining relative position of a particular amino acid between the two protein structures (e.g., between the three dimensional structures prefusion mature closed- and CD4-bound-HIV-1 Env protein) are known. For example the person of ordinary skill in the art can use known superimposition methods to compare the two structures (e.g., methods using the LSQKAB program (Kabsch W. *Acta. Cryst. A*32 922-923 (1976)).

In several embodiments, the recombinant HIV-1 Env protein is stabilized in a prefusion mature closed conformation by a disulfide bond between a cysteine introduced at an amino acid position that changes conformation, and a cysteine introduced into an amino acid position that does not change conformation, between the prefusion mature closed conformation and the CD4-bound conformation of HIV-1 Env. For example, in some embodiments, the recombinant HIV-1 Env protein is stabilized in a prefusion mature closed conformation by a disulfide bond between a pair of cysteines, wherein the first cysteine is in an amino acid position of the HIV-1 Env protein that has a root mean square deviation of at least 5 (such as at least 6, at least 7, at least 8, at least 9 or at least 10) angstroms between the three-dimensional structure of the HIV-1 Env protein prefusion mature closed and CD4-bound conformations, and the second cysteine is in an amino acid position of the HIV-1 Env protein that has a root mean square deviation of less than 4 (such as less than 3, 2, or 1) angstroms between the three-dimensional structure of the HIV-1 Env protein prefusion mature closed and CD4-bound conformations.

In additional embodiments, the recombinant HIV-1 Env protein is stabilized in a prefusion mature closed conformation by a disulfide bond between cysteines that are introduced at amino acid positions that both change conformation between the prefusion mature closed and CD4-bound conformations. For example, in some embodiments, the recombinant HIV-1 Env protein includes amino acid substitutions introducing a pair of cysteines, wherein the first cysteine and the second cysteine are at amino acid positions of the HIV-1 Env protein that both have a root mean square deviation of at least 5 (such as at least 6, at least 7, at least 8, at least 9 or at least 10) angstroms between the three-dimensional structure of the prefusion mature closed and CD4-bound conformations of the HIV-1 Env protein.

In several embodiments the recombinant HIV-1 Env ectodomain included in the trimer includes one or more amino acid substitutions that stabilize the V1V2 domain "cap" and/or V3 domain in the prefusion mature closed conformation.

For example, in some embodiments, the recombinant HIV-1 Env ectodomain included in the trimer includes a non-natural disulfide bond between a first cysteine in a position of the β2 sheet and a second cysteine in a gp120 positions of the β21 sheet of the HIV-1 ectodomain in the mature closed conformation as disclosed herein (see FIG. 11).

In some embodiments, the gp120 polypeptide in the recombinant HIV-1 Env ectodomain can include a non-natural disulfide bond between a pair of cysteine substitutions at one of gp120 positions 179-180 and one of gp120 positions 420-423; one of gp120 positions 190-210 and one of gp120 positions 425-437; one of gp120 positions 198-202 and one of gp120 positions 428-437; one of gp120 positions 179-180 and one of gp120 positions 421-423; or one of gp120 positions 195-201 to one of gp120 positions 423-433, wherein the non-natural disulfide bond stabilizes the HIV-1 Env ectodomain in the prefusion mature closed conformation.

In some embodiments, the gp120 polypeptide in the recombinant HIV-1 Env ectodomain can include a pair of cysteine substitutions that can form a disulfide bond to stabilize a trimer of the recombinant HIV-1 Env ectodomain in the mature closed conformation. Exemplary gp120 positions that can be mutated to cysteine, as well as exemplary mutations (in the context of the BG505 strain), and an exemplary sequence including the indicated mutations are provided in Table 6.

TABLE 6

Non-natural gp120-gp120 disulfide bonds.

| Exemplary Env positions (HXB2 numbering) | Exemplary Substitutions (HXB2 numbering) | Intra- or Inter-protomer? | Comment | Exemplary SEQ ID NO |
|---|---|---|---|---|
| 36 and 496 | V36C/V496C | Intra | Stabilize gp120 N and C termini | 649 |
| 36 and 498 | V36C/P498C | Intra | Stabilize gp120 N and C termini | 650 |
| 37 and 497 | T37C/A497C | Intra | Stabilize gp120 N and C termini | 651 |
| 38 and 496 | V38C/V496C | Intra | Stabilize gp120 N and C termini | 652 |
| 36 and 608 | V36C/V608C | Intra | stabilize V1V2 mature closed conformation | 82 |
| 55 and 77 | A55C/T77C | Intra | Inhibit α0 formation | 683 |
| 57 and 77 | D57C/T77C | Intra | Inhibit α0 formation | 98 |
| 58 and 77 | A58C/T77C | Intra | Inhibit α0 formation | 97 |
| 66 and 209 | V66C/S209C | Intra | Inhibit α0 formation | 101 |
| 68 and 208 | V68C/V208C | Intra | Inhibit α0 formation | 100 |
| 68 and 209 | V68C/S209C | Intra | Inhibit α0 formation | 99 |
| 120 and 315 | V120C/Q315C | Intra | stabilize V1V2 mature closed conformation | 70 |
| 122 and 125 | L122C/L125C | Intra | stabilize V1V2 mature closed conformation | 64 |
| 122 and 203 | L122C/Q203C | Intra | stabilize V1V2 mature closed conformation | 77, 785 |
| 122 and 317 | L122C/F317C | Intra | Locking the V3 to gp120 to prevent exposure/opening | 789 |
| 122 and 433 | L122C/A433C | Intra | stabilize V1V2 mature closed conformation | 162 |
| 124 and 164 | P124C/T164C | Inter | stabilize V1V2 mature closed conformation | 71 |
| 124 and 166 | P124C/R166C | Inter | stabilize V1V2 mature closed conformation | 20 |
| 128 and 165 | T128C/L165C | Inter | stabilize V1V2 mature closed conformation | 71 |
| 128 and 167 | T128C/T167C | Inter | stabilize V1V2 mature closed conformation | 72 |
| 163 and 170 | T163C/Q170C | Intra | Stabilize V1V2 | 662 |
| 164 and 197 | E164C/N197C | Inter | stabilize V1V2 mature closed conformation | 19 |
| 164 and 308 | S164C/H308C | Intra | Locking the V3 to V1V2 to prevent exposure/opening | 794 |
| 172 and 307 | E172C/I307C | Intra | Locking the V3 to V1V2 to prevent exposure/opening | 791 |
| 174 and 318 | S174C/A319C | Intra | stabilize V1V2 mature closed conformation | 8 |
| 174 and 319 | S174C/T319C | Intra | Locking the V3 to V1V2 to prevent exposure/opening | 793 |
| 175 and 320 | L175C/T320C | Intra | stabilize V1V2 mature closed conformation | 9, 795 |
| 176 and 180 | F176C/D180C | Intra | stabilize V1V2 mature closed conformation | 57 |
| 180 and 421 | D180C/K421C | Intra | stabilize V1V2 mature closed conformation | 28 |
| 180 and 423 | D180C/I423C | Intra | stabilize V1V2 mature closed conformation | 21 |
| 195 and 423 | N195C/I423C | Intra | stabilize V1V2 mature closed conformation | 22 |
| 195 and 433 | N195C/A433C | Intra | stabilize V1V2 mature closed conformation | 23, 777 |
| 199 and 431 | S199C/G431C | Intra | stabilize V1V2 mature closed conformation | 25 |
| 199 and 433 | S199C/A433C | Intra | stabilize V1V2 mature closed conformation | 24, 778 |
| 200 and 313 | A200C/P313C | Inter | stabilize V1V2 mature closed conformation | 12 |
| 200 and 432 | A200C/Q432C | Intra | Stabilize β21 to V1V2 | 653 |
| 201 and 433 | I201C/A433C | Intra | stabilize V1V2 mature closed conformation | 26, 773 |
| 202 and 434 | T202C/M434C | Intra | Stabilize β21 to V1V2 | 654 |
| 202 and 433 | T202C/A433C | Intra | Stabilize β21 to V1V2 | 656 |
| 203 and 317 | Q203C/F317C | Intra | Locking the V3 to gp120 to prevent exposure/opening | 788 |
| 204 and 434 | A204C/M434C | Intra | stabilize V1V2 mature closed conformation | 63 |
| 204 and 436 | A204C/A436C | Intra | stabilize V1V2 mature closed conformation | 58 |
| 206 and 318 | P206C/Y318C | Intra | Locking the V3 to gp120 to prevent exposure/opening | 792 |
| 212 and 252 | P212C/K252C | intra | stabilize V1V2 mature closed conformation | 60 |
| 225 and 245 | I225C/V245C | Intra | Stabilizes V1V1 | 646 |
| 225 and 488 | I225C/V488C | Intra | Stabilize V1V2 mature closed conformation | 659 |
| 257 and 375 | T257C/S375C | Intra | Stabilize V1V2 mature closed conformation | 682 |
| 294 and 333 | I294C/V333C | Intra | Stabilize core | 664 |
| 298 and 329 | R298C/A329C | Intra | stabilize V1V2 mature closed conformation | 74 |
| 304 and 440 | R304C/Q440C | Intra | Stabilize prefusion close conformation (through V3) | 743, 779, 787 |
| 318 and 437 | Y318C/P437C | Intra | stabilize V1V2 mature closed conformation | 53, 790 |
| 320 and 438 | T320C/P438C | Intra | stabilize V1V2 mature closed conformation | 27, 796 |
| 364 and 372 | S364C/T372C | Intra | stabilize V1V2 mature closed conformation | 80 |
| 370 and 426 | E370C/M426C | Intra | stabilize strand β20 to core gp120 | 170 |
| 380 and 426 | G380C/M426C | Intra | stabilize strand β20 to core gp120 | 171 |
| 382 and 424 | F382C/I424C | Intra | stabilize V1V2 mature closed conformation | 73 |
| 425 and 433 | N425C/A433C | Intra | stabilize V1V2 mature closed conformation (stabilize β20 to β21) | 69, 783 |
| 425 and 430 | N425C/I430C | Intra | Stabilizes CD4 binding loop (stabilize β20 to β21) | 52 |

In one non-limiting embodiment, the recombinant HIV-1 Env ectodomain can include cysteine substitutions at positions 201 and 433 (e.g., I201C and A433C substitutions). In additional embodiments, the recombinant HIV-1 Env ectodomain can include cysteine substitutions at positions 201 and 433 (e.g., I201C and A433C substitutions) and further include one or more additional mutations as disclosed herein. Exemplary additional mutations include those disclosed herein that stabilize the V1V2 domain, the V3 domain, or the CD4 binding site in the prefusion mature closed conformation, or a mutation that stabilizes gp41 in the prefusion mature closed conformation, such as a mutation that inhibits HR1 or HR2 formation or fusion peptide extension. Non-limiting examples of mutations that can be combined with the cysteine substitutions at positions 201 and 433 include the SOS, IP, SOSIP mutations, as well as any of the mutations listed in Table 9, below.

Cavity Filling Amino Acid Substitutions

Comparison of the structure of the mature closed conformation of the HIV-1 Env ectodomain trimer (e.g., in complex with PGT122 and 35O22 Fabs as disclosed herein) to the structure of the CD4-bound conformation of HIV-1 Env identifies several internal cavities or pockets in the mature closed conformation that collapse when the HIV-1 Env ectodomain trimer transitions from the prefusion closed conformation to the CD4-bound open conformation. These cavities include those listed in Table 8, below.

Accordingly, in several embodiments, the recombinant HIV-1 Env ectodomain trimer can be stabilized in the mature closed conformation by one or more amino acid substitutions that reduce the volume of an internal cavity that collapses in the CD4-bound conformation of the HIV-1 Env ectodomain trimer. For example, cavities can be filled by substituting amino acids with large side chains for those with small side chains. The cavities can be intra-protomer cavities, or inter-protomer cavities. The person of ordinary skill in the art can use methods provided herein to compare the structures of the mature closed and CD4-bound conformations of HIV-1 Env to identify suitable cavities, and amino acid substitutions for filling the identified cavities. Exemplary cavities, amino acid substitutions for reducing the volume of these cavities are provided in Table 8.

Exemplary HIV-1 Env positions for introducing cavity filling amino acid substitutions that stabilize the prefusion mature closed conformation of the HIV-1 Env ectodomain trimer are provided in Table 8, as are corresponding amino acid substitutions with reference to the BG505 strain, and an exemplary sequence including the indicated substitution.

TABLE 8

Exemplarity cavity-filling amino acid substitutions

| Position | Exemplary substitution residues | Exemplary substitution(s) | Exemplary SEQ ID NO | Cavity Location (CL) and stabilizing mechanism (SM) |
|---|---|---|---|---|
| 39 | W, M, I, F | Y39F, Y39W | 47-48 | CL: gp120/gp41 interface<br>SM: fill cavity and add hydrophobic interactions at the gp120-gp41 interactive surface |
| 50 | F, Y, L, I, M, V, W | T50W | 181 | CL: gp120/gp41 interface<br>SM: stabilize gp120/gp41 interface |
| 53 | W | F53W | 197 | CL: gp120-gp41 interface, near N-term of β-2<br>SM: Fill cavity between gp120 and gp41 to stabilize gp41 disordered region and gp120/gp41 interaction |
| 55 | F | A55F | 678 | CL: gp120 C1 with F substitution to stabilize gp120 N terminus |
| 61 | W | Y61W | 195 | CL: Middle of α1<br>SM: Fill cavity between gp120 and gp41; prevent CD4-induced α0 formation/α1 disruption |
| 68 | F, W, Y, L, I, M | V68L | 196 | CL: Loop between α-1 and β0<br>SM: Fill cavities that are otherwise filled by CD4 induced α0 formation |
| 70 | F, Y, W | A70F, A70Y | 143, 144 | CL: Close to A70, α0/α7<br>SM: Extension of hydrophobic/aromatic patch-gp41/gp120 stabilization |
| 75 | W, F, M | V75W, V75F, V75M | 90, 91, 92 | CL: gp120/gp41 interface<br>SM: stabilize gp120/gp41 interface |
| 77 | F | T77F | 676 | CL: gp120 C1 with F substitution to stabilize gp120 N terminus |
| 110 | F, Y, L, I, M, V, W | S110W | 178 | CL: trimer axis/gp41 interface boundary<br>SM: stabilize prefusion axis interactions/gp41 interface/prevent helix movement |
| 111 | F, Y, W | L111Y, L111F, L111W | 145, 146, 697 | CL: gp120 C1, Close to A70, α0/α7<br>SM: Extension of hydrophobic/aromatic patch-gp41/gp120 stabilization (α7/α0, cavity close to A70), Substitute W to stabilize gp120 terminus |
| 114 | F, Y, L, I, M, V, W | Q114W | 179 | CL: trimer axis/gp41 interface boundary<br>SM: stabilize prefusion axis interactions/gp41 interface/prevent helix movement |
| 115 | F, W, Y, L, I, M, V | S115W | 139 | CL: C-term of α1<br>SM: Reduces cavity at top of α1, which shifts conformation in CD4-bound state |
| 117 | F, Y, L, I, H, R, E, D, M, V, W | K117E, K117W | 175, 176 | CL: trimer axis<br>SM: stabilize prefusion axis interactions |
| 118 | F, W, Y, L, I, M, V | P118W | 140 | CL:<br>SM: Reduces cavity near top (c-term) of α1, which shifts conformation in CD4-bound state |
| 120 | F, Y, L, I, H, R, E, D, M, V, W | V120W | 128 | CL: Under V1V2 cap at N-term of β2<br>SM: stabilize V1V2 mature closed conformation/prevent bridging sheet formation, β2 extends in CD4-bound state, this stabilizes small hydrophobic pocket in ground state |
| 121 | F, Y, L, I, H, R, E, D, M, V | K121E | 177 | CL: trimer axis<br>SM: stabilize prefusion axis interactions |
| 123 | F, Y, L, M, V, W | T123W | 172 | CL: trimer axis<br>SM: stabilize prefusion axis interactions |
| 125 | F, W, Y, L, I, M, V | L125W, L125F | 131, 685 | CL: Cavity near N-term of V1V2 domain and V3 near residue 127 and 126-196 disulfide of V1V2<br>SM: Removal of ground state destabilization/flexibility cavity filling, stabilize V1/V2/V3 |

TABLE 8-continued

Exemplarity cavity-filling amino acid substitutions

| Position | Exemplary substitution residues | Exemplary substitution(s) | Exemplary SEQ ID NO | Cavity Location (CL) and stabilizing mechanism (SM) |
|---|---|---|---|---|
| 136 | W | N136W | 686 | CL: gp120 V1. Substitute W to stabilize V1/V2/V3 |
| 139 | F, M, I, Y, T; | T139W | 45 | CL: interface of V1V2 and V3 loops<br>SM: Stabilize interactions between V1V2 and V3 loops in the mature closed state |
| 151 | F, W, Y, L, I, M, V | R151E, | 132 | CL: near V1 loop at position 153<br>SM: Adding hydrophobic patch at V1 loop to V3 loop |
| 153 | F, W | E153F, E153W | 707, 708 | CL: V1V2-V3/gp120core interface, |
| 154 | F, W | L154F, L154W | 709, 710 | CL: gp120 V1/V2. Substitute F, Y or W, stabilize V1/V2/V3 |
| 159 | W, Y | F159W, F159Y | 133, 30 | CL: Primary hydrophobic pocket between V1V2 and V3 near residue 159<br>SM: Stabilize hydrophobic core of V1V2-V3 interactions |
| 161 | F, W, Y, L, I | M161W | 135 | CL: Hydrophobic patch at Cterm of V1V2 strand B<br>SM: Stabilize V1V2 strand B to V3 near trimeric interface |
| 164 | F, W | E164F, E164W | 711, 712 | CL: inter-protomer, Substitute F or W, |
| 173 | | Y173W | 703 | CL: gp120 V1/V2/V3. 173: Substitute W or F |
| 175 | F, W | L175F, L175W | 705, 706 | CL: V1V2-V3 interface, Substitute F or W, |
| 176 | W | F176W | 733 | CL: gp120 V1/V2. Substitute Y or W, stabilize V1/V2/V3 |
| 177 | W | Y177W | 198 | CL: C-term of beta C<br>SM: Fills cavity between V3 and gp120 core to stabilize closed V1V2 cap |
| 179 | F, Y, M, I, W | L179W | 46 | CL: V1V2 loop gp120 core interface<br>SM: Stabilize V1V2 loop-gp120 core interaction in mature closed state |
| 180 | 180: L, V, I, M | D180L | 123 | CL: V1V2 interaction near residue 180 with V3 and base of β21<br>SM: stabilize v1v2 to v3 along with destabilizing β21 from adopting CD4-bound-conformation |
| 191 | W, F | Y191W, Y191F | 4, 5 | CL:<br>SM: Stabilize V1V2 cap |
| 198 | F | T198F | 713 | CL: V1V2-gp120 core interface |
| 201 | F, Y, L, M, V | I201W | 173 | CL: parallel β #<br>SM: prevent bridging sheet formation |
| 202 | F, W | T202F, T202W | 714 | CL: V1V2-gp120 core interface, Substitute F or W, |
| 203 | F, W, Y, L, I, M, V | Q203V | 129 | CL: Under V1V2 cap at N-term of β2<br>SM: stabilize prefusion cap/prevent bridging sheet formation, β2 extends in CD4-bound state, this stabilizes small hydrophobic pocket in ground state |
| 204 | F, W | A204F, A204W | 716, 724 | CL: V1V2-gp120 core interface, Substitute F or W, |
| 208 | W, Y, F, M | V208W, V208Y, V208F, V208 | 93-96 | CL: between α1 and strand leading to bridging sheet in the CD4-bound conformation<br>SM: Destabilize CD4-bound conformation |
| 209 | R | S209R, | 196 | CL: Loop between β3 and β4<br>SM: Fill cavity otherwise filled by CD4 induced α0 formation |
| 220 | F, Y, L, I, M, V, W | P220W | 180 | CL:<br>SM: stabilize gp41 interface |
| 223 | Y, W | F223W | 31, 780 | CL: near β5<br>SM: stabilize gp120/gp41 interface |
| 245 | F | V245F | 700 | CL: gp120 C2. Substitute F to stabilize gp120 V1/V2/V3, interprotomer |
| 246 | F, W, Y, L, I, M, V | Q246W | 197 | CL: gp120-gp41 interface, near middle of β8<br>SM: Fill a cavity between gp120 and gp41 to stabilize gp41 disordered region and gp120/gp41 interaction |
| 254 | F | V254F | 670 | CL: gp120 C2 with F substitution to stabilize gp120 |
| 260 | F | L260F | 671 | CL: gp120 C2 with F substitution to stabilize gp120 |
| 261 | F | L261F | 672 | CL: gp120 C2 with F substitution to stabilize gp120, interprotomer |
| 263 | W | G263W | 673 | CL: gp120 C2 with W substitution to stabilize gp120, interprotomer |
| 302 | F, W | N302F, N302W | 725, 726 | CL: V3-V1V2/gp120 core interface |
| 309 | F, W, Y, L, M | I309W | 136 | CL: Hydrophobic patch at C-term of V1V2 strand B<br>SM: Stabilize V1V2 strand B to V3 near trimeric interface |
| 317 | W, Y | F317W | 134 | CL: Primary hydrophobic pocket between V1V2 and V3 near position 159<br>SM: Stabilize hydrophobic core of V1V2-V3 interactions |
| 323 | W | I323W | 690 | CL: gp120 V3. Substitute F to stabilize V1/V2/V3 |
| 326 | M, W, F, Y, R | I326R, I326F | 45, 691 | CL: at the interface of V1V2 and V3 loops<br>SM: Stabilize interactions between V1V2 and V3 loops in the mature closed state |
| 328 | 328: F, W, Y, L, I, M, V | Q328W | 132 | CL: near V3 loop<br>SM: Adding hydrophobic patch at V1 loop to V3 loop |
| 332 | F, Y, W | I332F | 198 | CL: C-term of beta V3B,<br>SM: Fills cavity between V3 and gp120 core to stabilize closed V1V2 cap |
| 380 | F | G380F | 667 | CL: gp120 C4 with F substitution to stabilize gp120 |

TABLE 8-continued

Exemplarity cavity-filling amino acid substitutions

| Position | Exemplary substitution residues | Exemplary substitution(s) | Exemplary SEQ ID NO | Cavity Location (CL) and stabilizing mechanism (SM) |
|---|---|---|---|---|
| 421 | 421: F, W, Y | K421W, | 123 | CL: V1V2 interaction near residue 180 with V3 and base of β21<br>SM: This will stabilize v1v2 to v3 along with destabilizing β21 from adopting CD4-bound-conformation |
| 423 | F, Y, L, M, V, W | I423F, I423W | 173, 717, 718 | CL: gp120core-V1V2 interface, parallel β #<br>SM: prevent bridging sheet formation |
| 426 | G, V, I, L, F, Y, W, R, K, P | M426W, M426A, M426F, M426P | 54, 75, 78, 83 | CL: CD4 binding site<br>SM: Constrains CD4 binding loop, Blocks transition to CD4 bound conformation |
| 429 | F, Y, L, I, M, V, W | R429W | 182 | CL: under parallel β#<br>SM: prevent bridging sheet formation |
| 431 | Any | G431P | 68, 782 | CL: CD4 binding site<br>SM: sterically interferes with CD4 binding specifically without affecting antibody binding |
| 432 | F, W | Q432F, Q432W | 719, 720 | CL: stabilize unliganded conformation of bridging sheet region |
| 436 | M, F, W | A436M, A436F, A436W | 721, 722, 723 | CL: stabilize unliganded conformation of bridging sheet region |
| 437 | F | P437F | 668 | CL: gp120 C terminus with F substitution and stabilize gp120 C terminus |
| 473 | Any | G473A, G473S, G473Y | 65-67, 781 | CL: CD4 binding site<br>SM: sterically interferes with CD4 binding specifically without affecting antibody binding |
| 478 | F | N478F | 660 | CL: gp120 C terminus substituted with F and stabilize gp120 C terminus |
| 522 | Y | F522Y | 34 | CL: near N-tern of fusion peptide<br>SM: Fusion Peptide Cavity Fill |
| 523 | F | L523F | 33 | CL: near N-tern of fusion peptide<br>SM: Fusion Peptide Cavity Fill |
| 530 | W | M530W | 29 | CL: gp41-tryptophan clasp<br>SM: stabilize interactions within gp41-tryptophan clasp |
| 534 | I, W, F, A, M, V | S534V, S534A | 47-48 | CL: gp120/gp41 interface<br>SM: fill cavity and add hydrophobic interactions at the gp120-gp41 interactive surface |
| 544 | F, Y, W | L544Y | 32 | CL: gp41 tip of α6<br>SM: stabilize gp120/gp41 interface |

The recombinant HIV-1 Env ectodomain included in the trimer can include any one of the cavity filling substitution at one of the HIV-1 Env positions listed in Table 8. The recombinant HIV-1 Env ectodomain can also include a combination of two or more (e.g., 3, 4, 5, 6, 7, or 8) of the cavity filling substitutions provided in Table 8 to stabilize the HIV-1 Env ectodomain trimer in the prefusion mature closed conformation.

Additional Substitutions

In some embodiments, the recombinant HIV-1 Env ectodomain can include one or more amino acid substitutions that destabilize the CD4-bound open conformation of the HIV-1 Env ectodomain trimer (and thereby prevent transition of the trimer from the prefusion closed conformation to the CD4-bound open conformation).

For example, in some embodiments the recombinant HIV-1 Env ectodomain can include an amino acid substitution that introduces a proline residue in the β21 sheet (e.g., positions 430-435), such as a proline substitution at position 432 or 433.

Exemplary HIV-1 Env positions for introducing an amino acid substitutions that destabilizes the CD4-bound open conformation of the HIV-1 Env ectodomain trimer are provided in Table 7, as are corresponding amino acid substitutions with reference to the BG505 strain, and an exemplary sequence including the indicated substitution.

TABLE 7

Destabilization of CD4-induced- and stabilization of prefusion mature conformations

| Exemplary substitution | Substitution compared to BG505 | | Exemplary SEQ ID NO |
|---|---|---|---|
| 112I | W112I | Stabilize V1V2 | 116 |
| 112M | W112M | Stabilize V1V2 | 117 |
| 120T | V120T | Stabilize V1V2 | 149 |
| 122K | L122K | Stabilize V1V2 | 150 |
| 120P | V120P | Stabilize V1V2 | 148 |
| 202P | T202P | Stabilize V1V2 | 147 |
| 427I | W427I | Stabilize prefusion closed conformation | 118 |
| 427M | W427M | Stabilize prefusion closed conformation | 119 |
| 429N | R429N | Stabilize prefusion closed conformation | 120 |
| 429L | R429L | Stabilize prefusion closed conformation | 116 |
| 432P | Q432P | Destabilizes CD4-bound conformation | 7, 775 |
| 432E | Q432E | Destabilizes CD4-bound conformation | 42 |
| 432D | Q432D | Destabilizes CD4-bound conformation | 43 |
| 433P | A433P | Destabilizes CD4-bound conformation | 6, 774 |
| 434P | 434P | Destabilizes CD4-bound conformation | 44 |
| 435P | 435P | Destabilizes CD4-bound conformation | 45 |
| 436P | 436P | Destabilizes CD4-bound conformation | 46 |
| 437A | P437A | Destabilizes CD4-bound conformation | 47 |
| 438A | P438A | Destabilizes CD4-bound conformation | 48 |
| 474A | D474A | Stabilize prefusion closed conformation | 118 |
| 476A | R476A | Stabilize prefusion closed conformation | 124 |

In several embodiments, the recombinant HIV-1 Env ectodomain can include one or more (e.g., 2, 3, 4, 5, 6, 7, or 8) of the amino acid substitutions as listed in Table 7 to destabilize the CD4-induced conformation of the HIV-1 ectodomain trimer (and thereby stabilize the HIV-1 Env ectodomain trimer in the prefusion mature closed conformation). Additionally, any of the substitutions shown in Table 7 can be combined with the other stabilizing substitutions described herein to stabilize the HIV-1 Env ectodomain trimer in the prefusion mature closed conformation.

In some embodiments, the recombinant HIV-1 Env ectodomain includes one or more amino acid substitutions that destabilize the formation of the α0 helix. As described in Example 1, the α0 helix (~residues 64-74) is present in the CD4-bound open conformation, but not the prefusion mature closed conformation, of trimeric HIV-1 Env. In some embodiments, the recombinant HIV-1 Env ectodomain includes a proline amino acid substitution at position 66 or 67, or both positions 66 and 67 (such as a H66P and/or N67P substitution) that disrupts formation of the α0 helix in the recombinant HIV-1 Env ectodomain trimer. Exemplary sequences including these mutations are set forth as SEQ ID NOs: 102-104.

In some embodiments, the recombinant HIV-1 Env ectodomain includes a non-natural disulfide bond between a pair of cysteine substitutions at one of positions 57-58 and position 77, or between position 66 or 68 and one of positions 207-209, wherein the non-natural disulfide bond destabilizes or disrupts formation of the α0 helix in the recombinant HIV-1 ectodomain. In some embodiments, the recombinant HIV-1 Env ectodomain can include a non-natural disulfide bond between a pair of cysteine substitutions at one or more of the following sets positions: 55 and 77, 57 and 77, 58 and 77, 66 and 207, 66 and 208, 66 and 209, 68 and 209, and 68 and 208, wherein the non-natural disulfide bond disrupts formation of the α0 helix in the recombinant HIV-1 ectodomain. In some embodiments, the recombinant HIV-1 Env ectodomain can include one or more of the following sets of amino acid substitutions: A55C and T77C, D57C and T77C, A58C and T77C, V66C and K207C, V66C and S209C, V68C and S209C, and V68C and V208C. Exemplary sequences including these mutations are set forth as SEQ ID NOs: 87, 98-101, and 683.

In more embodiments, the recombinant HIV-1 Env ectodomain can include a proline amino acid substitution at position 66 or 67, or both positions 66 and 67 (such as a H66P and/or N66P substitutions), and further include a pair of cysteine substitutions at positions 57 and 77, 58 and 77, 68 and 208, or 68 and 209, the combination of which disrupts formation of the α0 helix in the recombinant HIV-1 ectodomain. For example, in some embodiments, the recombinant HIV-1 Env ectodomain can include one of the following sets of amino acid substitutions: D57C/T77C, H66P, N67P; A58C/T77C, H66P, N67P; V68C/S209C, H66P, N67P; V68C/V208C, H66P, N67P; or V68C/S209C, H66P, N67P. Exemplary HIV-1 Env ectodomain sequences including these mutations are set forth as SEQ ID NOs: 105-108 and 109.

Stabilizing gp41

In additional embodiments, the recombinant HIV-1 Env ectodomain can include one or more disulfide bonds that stabilize gp41 in the mature closed prefusion conformation. Exemplary mutations include those that can form a non-natural gp120-gp41 disulfide bond or a non-natural gp41-gp41 disulfide bond. Exemplary HIV-1 Env positions that can be mutated to cysteine to form such stabilizing disulfide bonds, as well as exemplary mutations (in the context of the BG505 strain), and sequences including the indicated mutations are provided in Table 9, below.

TABLE 9

Non-natural gp120-gp41 and gp41 disulfide bonds

| Exemplary Env positions | Exemplary Substitutions | Intra- or Inter-protomer? | Comment | Exemplary SEQ ID NO |
|---|---|---|---|---|
| gp120-gp41 disulfide bonds | | | | |
| 41 and 540 | G41C/Q540C | Intra | Stabilize α6/Prevent HR1 formation | 14 |
| 41 and 541 | G41C/A541C | Intra | Stabilize α6/Prevent HR1 formation | 199, 200, 201 |
| 43 and 526 | P43C/A526C | Intra | Stabilize α6/Prevent HR1 formation | 15 |
| 51 and 574 | T51C/K574C | Intra | Stabilize α7/Prevent HR1 formation | 151 |
| 53 and 574 | F53C/K574C | Intra | Stabilize α7/Prevent HR1 formation | 152 |
| 51 and 578 | T51C/A578C | Intra | Stabilize α7/Prevent HR1 formation | 153 |
| 43 and 540 | P43C/Q540C | Intra | Stabilize α6/Prevent HR1 formation | 18 |
| 88 and 527 | N88C/G527C | Intra | Stabilize fusion peptide | 17 |
| 107 and 574 | D107C/K574C | Intra | Stabilize α7/Prevent HR1 formation | 166 |
| 220 and 578 | P220C/A578C | Intra | Stabilize α7/Prevent HR1 formation | 10 |
| 221 and 582 | A221C/A582C | Intra | Stabilize α7/Prevent HR1 formation | 11, 16 |
| 428 and 560 | Q428C/E560C | Inter | Stabilize α6/α7 linker/Prevent HR1 formation | 163 |
| 428 and 561 | Q428C/A561C | Inter | Stabilize α6/α7 linker/Prevent HR1 formation | 164 |
| 428 and 562 | Q428C/Q562C | Inter | Stabilize α6/α7 linker/Prevent HR1 formation | 165 |
| 498 and 610 | 498C/W610C | Intra | Prevent HR1/2 formation | 13 |
| 36 and 606 | V36C/T606C | Intra | Prevent HR1 formation | 647 |
| 37 and 606 | T37C/T606C | Intra] | Prevent HR1 formation | 648 |
| 41 and 537 | G41C/L537C | Intra | Prevent HR1 formation | 734 |
| 41 and 541 | G41C/A541C | Intra | Prevent HR1 formation | 736 |
| 43 and 526 | P43C/A526C | Intra | Prevent HR1 formation | 737 |
| 73 and 572 | A73C/G572C | Intra | Prevent HR1 formation | 738 |
| 84 and 521 | I84C/G521C | Intra | Prevent HR1 formation | 739 |
| 89 and 527 | V89C/G527C | Intra | Prevent HR1 formation | 740 |

TABLE 9-continued

Non-natural gp120-gp41 and gp41 disulfide bonds

| Exemplary Env positions | Exemplary Substitutions | Intra- or Inter-protomer? | Comment | Exemplary SEQ ID NO |
|---|---|---|---|---|
| 73 and 572 | A73C/G572C | Intra | Prevent HR1 formation | 741 |
| 84 and 521 | I84C/G521C | Intra | Prevent HR1 formation | 742 |
| 89 and 527 | V89C/G527C | Intra | Prevent HR1 formation | 743 |
| gp41 disulfide bonds | | | | |
| 550 and 575 | Q550C/Q579C | Intra | Prevent HR1 formation | 167, 169 |
| 551 and 575 | Q551C/Q575C | Intra | Prevent HR1 formation | 168 |

Any one or more of the pairs of cysteine substitutions listed in Table 9 can be included on a recombinant HIV-1 Env ectodomain to generate a recombinant HIV-1 Env ectodomain trimer stabilized in the prefusion mature closed conformation. Further, the recombinant HIV-1 Env ectodomain can include any one or more of the pairs of cysteine substitutions listed in Table 9 in combination with any of the other stabilizing mutations disclosed herein to generate a recombinant HIV-1 Env ectodomain that can form a trimer stabilized in the prefusion mature closed conformation.

Additionally, the recombinant HIV-1 Env ectodomain can include the SOS (501C and 605C), IP (559P), and/or SOSIP (501C, 605C, 559P) substitutions in combination with any of the stabilizing mutations disclosed herein to generate a recombinant HIV-1 Env ectodomain that can form a trimer stabilized in the prefusion mature closed conformation.

Exemplary Combinations

In several embodiments, any two or more of the HIV-1 Env mutations disclosed herein can combined to generate the recombinant HIV-1 Env ectodomain that can form a trimer stabilized in the prefusion mature closed conformation.

For example, in some embodiments, the recombinant HIV-1 Env ectodomain can include a non-natural disulfide bond that stabilizes the protein in a PGT122-bound conformation (e.g., with a V1V2 domain in a mature closed conformation; such as a non-natural disulfide bond between one or more of positions 201 and 433) and further include one or more amino acid substitutions that stabilize gp41 in a mature closed conformation (e.g., with distinct α6 and α7 helices; such as substitutions listed in Table 9, such as 41C/540C substitutions or a SOS, IP, SOSIP substitution). In further embodiments, the recombinant HIV-1 Env ectodomain can include a non-natural disulfide bond that stabilizes the protein in a PGT122-bound conformation (e.g., with a V1V2 domain in a mature closed conformation; such as a non-natural disulfide bond between one or more of positions 201 and 433) and includes one or more mutations that destabilize the CD4 binding domain, such as a substitution at position 473, and/or includes a cavity filling substitution, and further includes one or more amino acid substitutions that stabilize gp41 in a mature closed conformation (e.g., with distinct α6 and α7 helices; such as substitutions listed in Table 9, such as 41C/540C substitutions or a SOS, IP, SOSIP substitution).

In some embodiments, the recombinant HIV-1 Env ectodomain includes a pair of cysteine substitutions at one of positions 198-202 and one of positions 428-437 that form a non-natural disulfide bond, and further includes one or more amino acid substitutions that stabilize gp41 as described above (e.g., as listed in Table 9, such as 41C/540C substitutions), and/or can further include the SOS, IP, SOSIP mutations. In a non-limiting embodiment, the recombinant HIV-1 Env ectodomain includes 201C, 433C, 501C, 605C, and 559P substitutions (such as I201C, A433C, A501C, T605C, and I559P substitutions).

In some embodiments, the recombinant HIV-1 Env ectodomain includes a pair of cysteine substitutions at one of positions 174 and 319, 195 and 433, 199 and 433, 199 and 431, 201 and 433, 221 and 582, or 304 and 440, that form a non-natural disulfide bond, and further includes one or more amino acid substitutions that stabilize gp41 as described above (e.g., as listed in Table 9, such as 41C/540C substitutions), and/or can further include the SOS, IP, SOSIP mutations. In a non-limiting embodiment, the recombinant HIV-1 Env ectodomain includes 201C, 433C, 501C, 605C, and 559P substitutions (such as I201C, A433C, A501C, T605C, and I559P substitutions). In some such embodiments, the recombinant HIV-1 Env ectodomain can further includes a tryptophan substitution at position 223, or a proline substitution at position 432 or 433.

In more embodiments, the recombinant HIV-1 Env ectodomain includes two pairs of cysteine substitutions at one of positions (i) 195 and 433, and 304 and 440; (ii) 195 and 433, and 174 and 319; (iii) 199 and 433, and 304 and 440; (iv) 199 and 433, and 174 and 319; (v) 201 and 433, and 304 and 440; (vi) 201 and 433, and 174 and 319; that form two non-natural disulfide bonds, and can further includes one or more amino acid substitutions that stabilize gp41 as described above (e.g., as listed in Table 9, such as 41C/540C substitutions), and/or can further include the SOS, IP, SOSIP mutations. In a non-limiting embodiment, the recombinant HIV-1 Env ectodomain includes 201C, 433C, 501C, 605C, and 559P substitutions (such as I201C, A433C, A501C, T605C, and I559P substitutions). In some such embodiments, the recombinant HIV-1 Env ectodomain can further includes a tryptophan substitution at position 223, or a proline substitution at position 432 or 433. Exemplary immunogens include those with a BG505gp140.6R.SOSIP.664 background sequence further including I201C/A433C and R304C/Q440C substitutions; S199C/A433C and R304C/Q440C substitutions; I201C/A433C and V120C/Q315C substitutions; G473P and V120C/Q315C substitutions; G473Y and V120C/Q315C substitutions; G473P and R304C/Q440C substitutions; G473Y and R304C/Q440C substitutions; N425C/A433C and V120C/Q315C substitutions; and I201C/A433C and V120C/Q315C substitutions.

In additional embodiments, the recombinant HIV-1 Env ectodomain can include a combination of two or more non-natural disulfide bonds between pairs of cysteine substitutions as described above that (e.g., as listed in Table 6). Non-limiting examples of combinations of two or more non-natural disulfide bonds between pairs of cysteine substitutions are provided in Table 10. In some embodiments, the recombinant HIV-1 Env ectodomain can include one or more pairs of cysteine substitutions as described above that form a non-natural disulfide bond (e.g., as listed in Table 6), or a combination of pairs of cysteine substitutions as listed in Table 10, and further includes one or more amino acid substitutions that stabilize gp41 as described above (e.g., as listed in Table 9, such as 41C/540C substitutions), and/or can further include the SOS, IP, SOSIP mutations.

TABLE 10

Exemplary combinations of cysteine substitutions to generate non-natural disulfide bonds

| Positions | Exemplary substitutions | Exemplary SEQ ID NO |
|---|---|---|
| 200C/313C, 51C/574C | A200C/P313C, T51C/K574C | 151 |
| 200C/313C, 53C/574C | A200C/P313C, F53C/K574C | 152 |
| 200C/313C, 51C/578C | A200C/P313C, T51C/A578C | 153 |
| 128C/165C, 200C/313C, 51C/574C | T128C/L165C, A200C/P313C, T51C/K574C | 154 |
| 128C/165C, 200C/313C, 53C/574C | T128C/L165C, A200C/P313C, F53C/K574C | 155 |
| 128C/165C, 200C/313C, 51C/578C | T128C/L165C, A200C/P313C, T51C/A578C | 156 |

In some embodiments, the recombinant HIV-1 Env ectodomain can include a non-natural disulfide bond that stabilizes the protein in a PGT122-bound conformation (e.g., with a V1V2 domain in a mature closed conformation; such as a non-natural disulfide bond between one or more of positions 128 and 167, 174 and 318, 175 and 319, 204 and 434, 204 and 436, or 318 and 437) and further includes one or more mutations that destabilize the CD4 binding domain, such as a substitution at position 473 (such as a G473A substitution). For example, in some embodiments, the recombinant HIV-1 Env ectodomain can include one of the following sets of amino acid substitutions: T128C/T167C and G473A, S174C/A318C and G473A, L175C/A319C and G473A, A204C/M434C and G473A, A204C/A436C and G473A, or Y318C/P437C and G473A. In additional such embodiments, the recombinant HIV-1 Env ectodomain can further include one or more amino acid substitutions that stabilize gp41 as described above (e.g., as listed in Table 9, such as 41C/540C substitutions), and/or can further include the SOS, IP, SOSIP mutations. Exemplary gp140 sequences including such substitutions are set forth as SEQ ID NOs: 53, 55, 56, 58, 59, 72.

In additional embodiments, the recombinant HIV-1 Env ectodomain can include a cavity filling substitution as described above, and further includes an amino acid substitution that destabilizes the CD4-induced conformation of HIV-1 Env, such as a A433P substitution. In additional such embodiments, the recombinant HIV-1 Env ectodomain can further include one or more amino acid substitutions that stabilize gp41 as described above (e.g., as listed in Table 9, such as 41C/540C substitutions), and/or can further include the SOS, IP, SOSIP mutations. In a non-limiting embodiment, the recombinant HIV-1 Env ectodomain includes 433P, 501C, 605C, and 559P substitutions (such as A433P, A501C, T605C, and I559P substitutions).

In additional embodiments, the recombinant HIV-1 Env ectodomain includes a combination of two or more of the stabilizing substitutions described herein. For example, the recombinant HIV-1 Env ectodomain can include 429L and 427M (e.g., R429L and W427M substitutions), 437A and 438A (e.g., P437A and P438A substitutions), or 474A and 476A (e.g., D474A and R476A substitutions). In additional such embodiments, the recombinant HIV-1 Env ectodomain can further include one or more amino acid substitutions that stabilize gp41 as described above (e.g., as listed in Table 9, such as 41C/540C substitutions), and/or can further include the SOS, IP, SOSIP mutations. Exemplary sequences including these substitutions include those provided as SEQ ID NOs: 49, 115, and 122.

Additionally, any of the above cavity filling substitutions can be combined with the other stabilizing substitutions described herein to stabilize the HIV-1 Env ectodomain trimer in the prefusion mature closed conformation. For example, in some embodiments, the recombinant HIV-1 Env ectodomain includes a cavity filling substitution as described above, such as at one or more of gp120 positions 50, 110, 114, 117, 117, 120, 121, 121, 123, 159, 220, 426, 220, 429, and further includes substitutions to introduce a non-natural disulfide bond, such as I201C/A433C substitutions. In some non-limiting embodiments, the recombinant HIV-1 Env ectodomain includes a non-natural disulfide bond between I201C and A433C substitutions and further includes one of a T50W, S110W, Q114W, K117W, K117E, V120W, K121W, K121E, T123W, F159Y, M426W, P220W, or R429W cavity filling amino acid substitution. In some embodiments, the recombinant HIV-1 Env ectodomain includes a cavity filling substitution at position 193 (e.g., L193F), and further includes substitutions to introduce a non-natural disulfide bond between positions 195 and 423, such as N195C/I423C substitutions; an exemplary sequence is set forth as SEQ ID NO: 688. In some embodiments, the recombinant HIV-1 Env ectodomain includes a cavity filling substitution at position 431 (e.g., G431F), and further includes substitutions to introduce a non-natural disulfide bond between positions 202 and 434, such as T202C/M434C substitutions; an exemplary sequence is set forth as SEQ ID NO: 655. In some non-limiting embodiments, the recombinant HIV-1 Env ectodomain includes a non-natural disulfide bond between I201C and A433C substitutions and further includes one of a T50W, S110W, Q114W, K117W, K117E, V120W, K121W, K121E, T123W, F159Y, M426W, P220W, or R429W cavity filling amino acid substitution. In additional such embodiments, the recombinant HIV-1 Env ectodomain can further include one or more amino acid substitutions that stabilize gp41 as described above (e.g., as listed in Table 9, such as 41C/540C substitutions), and/or can further include the SOS, IP, SOSIP mutations. Exemplary recombinant HIV-1 Env ectodomain sequences including such substitutions are set forth as SEQ ID NOs: 120, 183-194.

In several embodiments, the recombinant HIV-1 Env ectodomain can include a combination of substitutions as set forth in Table 11, that include at least one cavity filling substitution.

TABLE 11

Exemplarity cavity-filling amino acid substitutions

| Position | Exemplary substitutions | Exemplary Substitutions | Exemplary SEQ ID NO | Cavity Location (CL) and stabilizing mechanism (SM) |
|---|---|---|---|---|
| 120, 203 | 201: F, W, Y, L, I, M; 203: F, W, Y, L, I, M, V | V120W, Q203V | 129 | CL: Under V1V2 cap at N-term of β2<br>SM: stabilize prefusion cap/prevent bridging sheet formation, β2 extends in CD4-bound state, this stabilizes small hydrophobic pocket in ground state |
| 39, 534 | 39: W, M, I, F 534: I, W, F, A, M, V | Y39F, S534V; Y39W, S534A | 47-48 | CL: gp120/gp41 interface<br>SM: fill cavity and add hydrophobic interactions at the gp120-gp41 interactive surface |
| 39, 534 + T37V, T499V | 39: W, M, I, F; 534: I, W, F, A, M, V | Y39F, S534V, T37V, T499V | 49 | CL: gp120/gp41 interface<br>SM: fill cavity and add hydrophobic interactions at the gp120-gp41 interactive surface |
| 39, 534 + Y40F, T37V, T499V | 39: W, M, I, F; 534: I, W, F, A, M, V | Y39F, Y40F, S534V, T37V, T499V | 50 | CL: gp120/gp41 interface<br>SM: fill cavity and add hydrophobic interactions at the gp120-gp41 interactive surface |
| 53, 246 | 246: F, W, Y, L, I, M, V | F53W, Q246W | 197 | CL: gp120-gp41 interface, N-term of β2, middle of β8<br>SM: Fill a cavity between gp120 and gp41 to stabilize gp41 disordered region and gp120/gp41 interaction |
| 68, 209, | 68: F, W, Y, L, I, M | V68L, S209R | 196 | CL: Loop between α1 and β0 and loop between β3 and β4<br>SM: Fill cavities that are otherwise filled by CD4 induced α0 formation |
| 125, delP124 | F, W, Y, L, I, M, V | L125W_deltaP124 | 131 | CL: Cavity between N-term of V1V2 domain and V3 near residue 127 and 126-196 disulfide of V1V2<br>SM: Removal of ground state destabilization/flexibility cavity filling/proline removal |
| 139, 326 | 139: F. M, I, Y, T; 326: M, W, F, Y, R | T139W, I326R | 45 | CL: at the interface of V1V2 and V3 loops<br>SM: Stabilize interactions between V1V2 and V3 loops in the mature closed state |
| 151, 153, 328 | 153: F, W, Y, L, I, M, V; 328: F, W, Y, L, I, M, V | R151E, E153W, Q328W | 132 | CL: V1 loop at position 153<br>SM: Adding hydrophobic patch at V1 loop to V3 loop |
| 177, 323 | 323: F, Y, W | Y177W, I332F | 198 | CL: C-term of beta C, C-term of beta V3B,<br>SM: Fills cavity between V3 and gp120 core to stabilize closed V1V2 cap |
| 180, 421, | 421: F, W, Y; 180: L, V, I, M | D180L, K421W | 123 | CL: V1V2 interaction near residue 180 with V3 and base of β21<br>SM: This will stabilize v1v2 to v3 along with destabilizing β21 from adopting CD4-bound-conformation |
| 201, 423 | F, Y, L, M, V | I201W, I423W | 173 | CL: parallel β #<br>SM: prevent bridging sheet formation |
| 223, 544 | 223: Y, W 544: F, Y, W | F223W, L544Y | 32 | CL: gp41 tip of α6<br>SM: stabilize gp120/gp41 interface |
| L125, 195 | W | L125W, I195W | 701 | CL: V1V2-V3 interface near 126-196 disulfide bond |
| 176, 323 | 176: Y, W; 323: F, Y, W | F176W/I323Y | 730 | CL: gp120 V1/V2/V3, stabilize V1/V2/V3 |
| 176, 154 | 176: Y, W; 154: F, Y, W | F176W/L154W | 731 | CL: gp120 V1/V2, stabilize V1/V2/V3 |
| 159, 154 | 159: Y, W; 154: F, Y, W | F159Y/L154W | 732 | CL: gp120 V1/V2, stabilize V1/V2/V3 |
| I251, 260 | F | I251F/L260F | 658 | CL: Engineering hydrophobic core between gp120 V2/V3 with double F substitution to stabilize V1/V2/V3 |

In some embodiments, the recombinant HIV-1 Env ectodomain comprises gp120-gp41 protomers comprising the SOSIP and 201C/433C substitutions and further comprising a cavity filling substitution (such as a Y, F, or M substitution) at any one of positions: 70; 75; 110; 111; 112; 115; 117; 118; 120; 153; 154; 159; 164; 172; 175; 176; 179; 191; 193; 194; 198; 202; 204; 208; 223; 304; 307; 309; 315; 316; 323; 423; 427; 430; 432; 432; 436; 544; 580; 583; 159 and 323; 44 and 537; 544 and 223; 544, 537, and 223; 580 and 583; 125 and 194; 134, 175, 322, and 326; 134, 322, and 326; 134, 136, 150, and 326; 154, 300, 302, and 320; 120, 203, and 318; 120 and 315; 177 and 420; 177, 328, and 420; 116, 426, and 432; 426 and 432; 134, 175, 322, 326, 136, and 150; 120, 203, 318, and 315; 154, 300, 302, 320, 177, and 420; or 139, 140, 324, and 325.

In some embodiments, the recombinant HIV-1 Env ectodomain comprises gp120-gp41 protomers comprising the SOSIP and 201C/433C substitutions and further comprising a substitution to destabilize the CD4-induced conformation, such as a F210A; F210S; Q432P; R429N; R429L; R429L and W427M; T202P; or V120T substitution In some embodiments, the recombinant HIV-1 Env ectodomain comprises gp120-gp41 protomers comprising the SOSIP and 201C/433C substitutions and further comprising cysteine substitutions to introduce a non-natural disulfide bond, such as T538C and Q652C; R304C and Q440C; G431GC and S199C; A58C and T77C; D57C and T77C In some embodiments, the recombinant HIV-1 Env ectodomain comprises gp120-gp41 protomers comprising the SOSIP and 201C/433C substitutions and further comprising substitutions to disrupt formation of helix 0, such as W69P; V68P; T71P; N67P; H66P; or N67P and H66P In some embodiments, the recombinant HIV-1 Env ectodomain comprises gp120-gp41 protomers comprising the SOSIP and 201C/433C substitutions and further comprising substitutions to destabilize the gp41 helix bundle, such as I573T; G594N; I573T and G594N; I573T and G594N and K574E; I573T, G594N, and K574T.

N-Linked Glycosylation Sites

In several embodiments, the recombinant HIV-1 Env ectodomain trimer can includes one or more N-linked glycosylation sites introduced onto the membrane proximal portion of the trimer to mask non-neutralizing epitopes present on this portion of the trimer. Such mutations are typically utilized in soluble embodiments of the recombinant HIV-1 Env ectodomain trimer. To create an N-linked glycosylation site, the sequence Asn-X-Ser/Thr (where X is any amino acid except Pro) can to be introduced. This can be accomplished by substitution of a Ser/Thr amino acid two residues C-terminal to a native Asn residue, or by substitution of an Asn amino acid two residues N-terminal to a native Ser/Thr residue, or by substitution of both an Asn and Ser/Thr residue separated by one non-proline amino acid. In some embodiments, the recombinant HIV-1 Env ectodomain comprises one or more amino acid substitutions that introduce an N-linked glycosylation site at the N-terminus of the gp120 polypeptide, the C-terminus of the gp120 polypeptide, and/or the C-terminus of the gp41 polypeptide. Exemplary amino acid substitutions for introducing one or more such N-linked glycosylation sites are provided under code D of the Table in Table 13, and are provided in Table 12, below:

TABLE 12

Exemplary N-linked glycan mutants to mask non-neutralizing epitopes.

| Glycan position | Exemplary substitutions | Exemplary SEQ ID NO |
|---|---|---|
| 504 | 504N/506T | 453 |
| 661 | 661N/663T | 454 |
| 504 and 661 | 504N/506T, 661N/663T | 455 |
| 502 | K502N/R504T | 456 |
| 658 | Q658N/L660T | 457 |
| 33 | W35T | 458 |
| 35 | W35N | 459 |
| 35 and 504 | W35N, R504N/V506T | 460 |
| 33 and 661 | W35T, L661N/L663T | 461 |
| 502 and 661 | K502N/R504T, L661N/L663T | 462 |

Antibody Stabilization

In additional embodiments, the disclosed immunogens can include a recombinant HIV-1 Env ectodomain trimer covalently linked (e.g., by a non-natural disulfide bond) to one or more neutralizing antibodies, such as the VRC01, PGT122, or 35O22 antibodies. Linkage to the neutralizing antibody can increase the stability of the immunogen in the prefusion mature closed conformation.

35O22

In some embodiments, the recombinant HIV-1 Env ectodomain trimer includes a recombinant HIV-1 Env ectodomain including a cysteine substitution that can form a non-natural disulfide bond with a cysteine residue in the heavy or light chain variable region of the 35O22 monoclonal antibody. For example, in some embodiments, the HIV-1 ectodomain includes a cysteine substitution at position 90, which can form a non-natural disulfide bond with a cysteine at position 80 (kabat numbering) of the 35O22 heavy chain variable region. In some embodiments, the HIV-1 ectodomain includes a cysteine substitution at position 238, which can form a non-natural disulfide bond with a cysteine at position 77 (kabat numbering) of the 35O22 heavy chain variable region. In some embodiments, the HIV-1 ectodomain includes a cysteine substitution at position 529, which can form a non-natural disulfide bond with a cysteine at position 111 (kabat numbering) of the 35O22 heavy chain variable region. In some embodiments, the HIV-1 ectodomain includes a cysteine substitution at position 624, which can form a non-natural disulfide bond with a cysteine at position 109 or 112 (kabat numbering) of the 35O22 heavy chain variable region. In some embodiments, the HIV-1 ectodomain includes a cysteine substitution at position 625, which can form a non-natural disulfide bond with a cysteine at position 109 (kabat numbering) of the 35O22 heavy chain variable region. Exemplary sequences for use in such embodiments are provided under code C of the Table in Table 13. For example, exemplary recombinant HIV-1 Env ectodomain sequences including such cysteine substitutions are set forth as SEQ ID NOs: 401-405, and 411. Additionally, exemplary 35O22 heavy chain variable region sequences for use in such embodiments are set forth as SEQ ID NOs: 406-410.

VRC01

In some embodiments, the recombinant HIV-1 Env ectodomain trimer includes a recombinant HIV-1 Env ectodomain including a cysteine substitution that can form a non-natural disulfide bond with a cysteine residue in the heavy or light chain variable region of the VRC01 monoclonal antibody. In some embodiments, the recombinant HIV-1 Env ectodomain trimer includes a recombinant HIV-1 Env ectodomain including a cysteine substitution at position 449 (e.g., a G459C substitution, HXB2 numbering) that can form a non-natural disulfide bond with a heavy chain variable region of a VRC01 monoclonal antibody comprising a cysteine substitution at heavy chain position 60 or 61 (kabat numbering). Exemplary sequences for use in such embodiments are provided under code C of the Table in Table 13. For example, exemplary recombinant HIV-1 Env ectodomain sequences including a position 459 cysteine substitution are set forth as SEQ ID NOs: 412-436. Exemplary VRC01 heavy and light chain sequences for use in such embodiments (e.g., including heavy chain variable region with a cysteine substitution at position 60 or 61) are set forth as SEQ ID NOs: 437-448.

PGT122

In some embodiments, the recombinant HIV-1 Env ectodomain trimer includes a recombinant HIV-1 Env ectodomain including a cysteine substitution that can form a non-natural disulfide bond with a cysteine residue in the heavy or light chain variable region of the PGT122 monoclonal antibody. In some embodiments, the recombinant HIV-1 Env ectodomain trimer includes a recombinant HIV-1 Env ectodomain including a cysteine substitution at position β23 (e.g., a I323C substitution, HXB2 numbering) that can form a non-natural disulfide bond with a heavy chain variable region of a PGT122 monoclonal antibody comprising a cysteine substitution at heavy chain position 29 or 67 (kabat numbering). Exemplary sequences for use in such embodiments are provided under code C of the Table in Table 13. For example, exemplary recombinant HIV-1 Env ectodomain sequences including a position 323 cysteine substitution are set forth as SEQ ID NOs: 449-450. Exemplary VRC01 heavy and light chain sequences for use in such embodiments (e.g., including heavy chain variable region with a cysteine substitution at position 29 or 67) are set forth as SEQ ID NOs: 451-452.

Chimeric Env Ectodomains

In some embodiments, the recombinant HIV-1 Env ectodomain stabilized in the prefusion mature closed conformation can include sequences from multiple strains of HIV-1. For example, the recombinant HIV-1 Env ectodomain can include a gp120 sequence from a first HIV-1 strain and a gp41 sequence from a heterologous HIV-1 strain, or a particular structural domain (such as the V1V2 domain) from a HIV-1 strain of interest (such as CAP256.SU, BB201.B42, a KER2018.11, a CH070.1, a ZM233.6, a Q23.17, a A244, a T250-4, or a WITO.33) with the remainder of the HIV-1 Env ectodomain from a heterologous HIV-1 strain (such as BG505). The chimeric HIV-1 Env ectodomain can further include any of the amino acid substitutions described herein, for example the 201C/433C, SOSIP, and DS substitutions for stabilization in the prefusion mature closed conformation. In the context of inducing an immune response in a subject that can control infection across multiple HIV-1 strains, the use of immunogens based on diverse HIV-1 strains can overcome the intrinsic sequence diversity of HIV-1 Env. Exemplary sequences of recombinant HIV-1 Env ectodomains linked to a nanoparticle subunit are provided under code H in Table 13 included in Example 15.

Exemplary sequences of chimeric HIV-1 Env ectodomain trimers that include the V1V2 domain sequence (positions 126-196) of the CAP256.SU, BB201.B42, KER2018.11, CH070.1, ZM233.6, Q23.17, A244, T250-4, or WITO.33 strains of HIV-1, with the remainder including BG505.SOSIP.DS.368R sequence, are provided as follows: Q23.17 V1V2 chimera (SEQ ID NO: 2126), ZM233.6 V1V2 chimera (SEQ ID NO: 2125), WITO.33 V1V2 chimera (SEQ ID NO: 2128), A244 V1V2 chimera (SEQ ID NO: 2127), BB201.B42 V1V2 chimera (SEQ ID NO: 2122), KER2018.11 V1V2 chimera (SEQ ID NO: 2123), CH070.1 V1V2 chimera (SEQ ID NO: 2124), CAP256.SU V1V2 chimera (SEQ ID NO: 2121), and T-250-4 V1V2 chimera (SEQ ID NO: 2129).

Platform

As described in the Examples, prefusion mature gp41 wraps its hydrophobic core around extended N- and C-termini-strands of gp120 (see FIGS. 11 and 38). Accordingly, in some embodiments, the recombinant HIV-1 Env ectodomain trimer can include a membrane proximal "platform" including the N- and C-terminal regions of gp120, and the gp41 ectodomain, from a first HIV-1 strain (such as BG505), and the remainder of gp120 from one or more heterologous HIV-1 strains. This chimeric design allows for production of heterogeneous HIV-1 Env proteins that comprise membrane distal features of interest (such as the V1V2 domain, V3 domain, and CD4 binding site).

In some embodiments, the recombinant Env ectodomain includes N- and C-terminal regions of gp120 as well as the gp41 ectodomain from a first HIV-1 strain (such as BG505, for example, with SOSIP substitutions), and the remainder of gp120 from a heterologous HIV-1 strain. In some embodiments, the heterologous HIV-1 strain can be a subtype A (such as BI369.9A, MB201.A1, QH209.14M.A2), subtype B (such as AC10.29), subtype C (such as 0921.V2.C14, 16055-2.3, 25925-2.22, 286.36, CAP45.G3, CNE58, DU156.12, DU422.01, MW965.26, ZM53.12, ZM55.28a, ZM106.9), subtype CRF AC (such as 3301.V1.C24, 6545.V4.C1), subtype CFR AE (such as 620345.c1, C1080.c3, C4118.09, CNE55, TH966.8) and subtype CRF BC (such as CH038.12, CH117.4) strain of HIV-1.

In some embodiments, the recombinant HIV-1 Env ectodomain can include a gp41 ectodomain, an N-terminal region of the gp120 polypeptide comprising a β-4 strand and a C-terminal region of the gp120 polypeptide comprising a β26 strand from a first strain of HIV-1 (such as BG505), and all or a portion of the remaining residues of the gp120 polypeptide are from one or more heterologous HIV-1 strains. The heterologous strain can be, for example, one of CAP256.SU (SEQ ID NO: 51), a BB201.B42 (SEQ ID NO: 81), a KER2018.11 (SEQ ID NO: 107), a CH070.1 (SEQ ID NO: 174), a ZM233.6 (SEQ ID NO: 745), a Q23.17 (SEQ ID NO: 746), a A244 (SEQ ID NO: 747), a T250-4 (SEQ ID NO: 2114), a WITO.33 (SEQ ID NO: 748), a 426c (with N276D, N460D, N463D, SEQ ID NO: 2144, a d45-01dG5 (2145), or a JRFL (SEQ ID NO: 2115) strain of HIV-1. In additional embodiments, the N-terminal region of the gp120 polypeptide can further include the β-3 strand from the first HIV-1 strain (such as BG505). In more embodiments the C-terminal region of the gp120 polypeptide can further include the β25 strand or the β25 strand and all or a portion of the α5 helix from the first HIV-1 strain (such as BG505). In more embodiments, the N-terminal region of the gp120 polypeptide can include from 5 to 30 (such as 10, 30, 5-20, 5-25, 5-15, 5-10, 10-20, 20-30, 15-25, or 5, 10, 15, 20, 25) amino acids and/or the C-terminal region of the gp120 polypeptide can include from 5-40 (such as 10-40, 5-30, 5-25, 5-20, 10-20, 20-30, 30-40, 10-30, 20-40, or 5, 10, 15, 20, 25, 30, or 35) amino acids, from the N- or C-terminus of the gp120 polypeptide, respectively, from the first strain of HIV-1 (such as BG505). Any of the stabilizing amino acid substitutions (such as the SOSIP substitutions, and/or the 201C/433C substitutions) can be included in the chimeric HIV-1 Env ectodomain.

In some embodiments, the recombinant Env ectodomain can include gp120 residues 31-45 and 478-507, and gp41 residues (e.g., 512-664) from the first HIV-1 strain (such as BG505), and the remainder of the gp120 residues in the Env protein can be from a heterologous HIV-1 strain. For example, the recombinant Env ectodomain can include gp120 positions 31-45 and 478-507, and gp41 residues (e.g., 512-664) from the BG505 strain with SOSIP substitution (e.g., as set forth as SEQ ID NO: 3), and the remaining gp120 residues in the Env ectodomain can be from any one of the CAP256.SU, BB201.B42, KER2018.11, CH070.1, ZM233.6, Q23.17, A244, WITO.33, JRFL, 426c (with N276D, N460D, N463D), d45-01dG5, BI369.9A, MB201.A1, QH209.14M.A2, 0921.V2.C14, 16055-2.3, 25925-2.22, 286.36, CAP45.G3, DU156.12, DU422.01, MW965.26, ZM53.12, ZM55.28a, ZM106.9, 3301.V1.C24, 6545.V4.C1, 620345.c1, C1080.c3, C4118.09, CNE55, TH966.8, AC10.29, CH038.12, CNE58, or CH117.4 strains of HIV-1. Any of the stabilizing amino acid substitutions (such as the SOSIP substitutions, and/or the 201C/433C substitutions) can be included in the chimeric HIV-1 Env ectodomain. Non-limiting examples of sequences of such chimeric HIV-1 Env ectodomains (that may also include one or more amino acid substitutions, such as 201C/433C and SOSIP substitutions to stabilize the HIV-1 ectodomain in the prefusion mature closed conformation) are provided herein as SEQ ID NOs: 379-386, 387, 764-772, and 856-1036. Thus, in some embodiments, the recombinant HIV-1 Env protein includes an amino acid sequence set forth as any one of SEQ ID NOs: 379-386, 387, 764-772, and 856-1036, or an amino acid sequence at least 80% (such as at least 90%, at least 95%, at least 96%, at least 97%, at least 98%, or at least 99%) identical to any one of SEQ ID NOs: 379-386, 387, 764-772, and 856-1036. In a preferred embodiment, the recombinant HIV-1 Env protein includes an amino acid sequence set forth as any one of SEQ ID NOs: 856, 872, 881, 888, 902, 908, 917, 924, 930, 933, 937, 938, 940, 953, 956, 962, 964, 978, 871, 973, 990, 1010, 1025, 1034, or 1098, or an amino acid sequence at least 80% (such as at least 90%, at least 95%, at least 96%, at least 97%, at least 98%, or at least 99%) identical to any one of SEQ ID NOs: 856, 872, 881, 888, 902, 908, 917, 924, 930, 933, 937, 938, 940, 953, 956, 962, 964, 978, 871, 973, 990, 1010, 1025, 1034, or 1098.

Interface Residues

In more embodiments, the gp120 portion of the recombinant HIV-1 Env ectodomain (from the heterologous HIV-1 strain) can further include one or more substitutions at the gp120-gp41 interface that introduce residues from the first HIV-1 strain. In some embodiments, such substitutions can enhance the stabilization of the HIV-1 ectodomain in the prefusion mature conformation by maintaining native BG505 interaction between the membrane proximal "platform" and the core gp120. In some embodiments, the substitutions at the gp120-gp41 interface that introduce residues from the first HIV-1 strain can include substitutions at gp120 positions 46-54, 70-75, 84-89, 99, 102, 106, 107, 114, 215, 220-224, 226, 244, 471-473, and 476-477 (referred to herein as "Interface Residue Set A"). In some embodiments, the recombinant HIV-1 Env ectodomain includes gp120 residues 31-45 and 478-507, and gp41 residues (e.g., 512-664), from a first HIV-1 strain (such as the BG505 strain), and includes gp120 residues 46-477 from a heterologous strain of HIV-1 (such as the CAP256.SU, BB201.B42, KER2018.11, CH070.1, ZM233.6, Q23.17, A244, WITO.33, JRFL, 426c (with N276D, N460D, N463D), d45-01dG5, BI369.9A, MB201.A1, QH209.14M.A2, 0921.V2.C14, 16055-2.3, 25925-2.22, 286.36, CAP45.G3, DU156.12, DU422.01, MW965.26, ZM53.12, ZM55.28a, ZM106.9, 3301.V1.C24, 6545.V4.C1, 620345.c1, C1080.c3, C4118.09, CNE55, TH966.8, AC10.29, CH038.12, CNE58, or CH117.4 strain of HIV-1), and further includes substitutions in the gp120 residues from the heterologous strain that introduce residues from the first HIV-1 strain at the Interface Residue Set A positions of gp120. Non-limiting examples of sequences of such chimeric HIV-1 Env ectodomains (that may also include one or more amino acid substitutions, such as 201C/433C and SOSIP substitutions to stabilize the HIV-1 ectodomain in the prefusion mature closed conformation) are provided herein as SEQ ID NOs: 579-586, 588-595, and 1036-1056. Thus, in some embodiments, the recombinant HIV-1 Env protein includes an amino acid sequence set forth as any one of SEQ ID NOs: 579-586, 588-595, and 1036-1056, or an amino acid sequence at least 80% (such as at least 90%, at least 95%, at least 96%, at least 97%, at least 98%, or at least 99%) identical to any one of SEQ ID NOs: 579-586, 588-595, and 1036-1056.

Additional Description of Chimeric Domains

In some embodiments, the chimeric HIV-1 Env ectodomain can further include additional structural domains or elements from the first HIV-1 strain (such as BG505) in place of those of the heterologous strain, for example, strand C of the V1V2 domain (such as gp120 positions 166-173), a V3 domain (such as gp120 positions 296-331), a V2 loop (such as gp120 positions 154-205), a V1 loop (such as gp120 positions 119-153), positions 191-205. In some embodiments, the chimeric HIV-1 Env ectodomain can include from the first HIV-1 strain (such as BG505): a V2 loop and a V3 loop; a Strand C of the V1V2 domain and a V3 domain; positions 191-205 and a Strand C of the V1V2 domain; a V1 loop and a V3 domain; a V1 loop, a Strand C of the V1V2 domain, and a V3 domain; a V1 loop, a V2 loop, and a V3 domain; or a V1V2 domain. Exemplary sequences concerning such chimeric HIV-1 Env ectodomains are provided as SEQ ID NOs: 1727-1764.

Chimeras of Three Strains

In additional embodiments, the recombinant HIV-1 Env ectodomain trimer can be a chimera having unique antigenic characteristics that provide for binding to mature and unmutated common ancestor (UCA) forms of multiple classes of broadly neutralizing antibodies (e.g., targeting the CD4 binding site and the V1V2 domain). Such recombinant HIV-1 Env ectodomain trimers are of particular interest for use as a "prime" immunogen in a prime-boost immunization protocol for eliciting an immune response to HIV-1 Env.

For example, in some embodiments, the recombinant HIV-1 Env ectodomain trimer can be a chimera comprising amino acid sequences from three HIV-1 strains, including a membrane proximal "platform" from a first strain, a V1V2 domain from a second strain, and the remainder from a heterologous strain. In a non-limiting example, the V1V2 domain can be from an Env protein (such as one of CAP256.SU, BB201.B42, KER2018.11, CH070.1, ZM233.6, Q23.17, A244, T250-4, or WITO.33) that binds to a UCA form of a broadly neutralizing antibody (e.g., VRC26 or PGT145), such as described in Example 13. The remainder sequences of the chimera can also be from an Env protein that binds to a UCA form of a broadly neutralizing antibody (such as 45_01dG5 or 426c with amino acid substitutions to remove N-linked glycan sequons at positions 276, 460, 463), such as a UCA form or a VRC01-class antibody, for example VRC01 gHgL as described in Example 13. The sequences of the first, second, and heterologous strains are further modified to include the one or more amino acid substitutions that stabilize the recombinant HIV-1 Env ectodomain trimer in the prefusion mature closed conformation (such as SOS, IP, and DS substitutions), and can also include additional substitutions as needed, for example, substitutions to increase protease cleavage (such as the R6 substitution), or to increase or decrease the desired number of glycans (such as addition of glycan sequons at positions 504 and 661, and/or at position 332).

In some embodiments, the recombinant HIV-1 Env ectodomain trimer can be a chimera comprising amino acid sequences from three HIV-1 strains, wherein the recombinant HIV-1 Env ectodomain includes (1) a gp41 ectodomain (such as positions 512-664), an N-terminal region of the gp120 polypeptide comprising a 3-4 strand, and a C-terminal region of the gp120 polypeptide comprising a β26 strand, from a first strain of HIV-1 (such as BG505), (2) a V1V2 domain (such as gp120 positions 126-196) of the gp120 polypeptide from a second strain of HIV-1 (such as one of CAP256.SU, BB201.B42, KER2018.11, CH070.1, ZM233.6, Q23.17, A244, T250-4, or WITO.33; and (3) the remaining sequence of the gp120 polypeptide from a heterologous strain of HIV-1 (such as 45_01dG5 or 426c with amino acid substitutions to remove N-linked glycan sequons at positions 276, 460, 463). In some such embodiments, the N-terminal region of the gp120 polypeptide can further comprises a β-3 strand from the first HIV-1 strain; and the C-terminal region of the gp120 polypeptide further comprises a β25 strand or a β25 strand and a α5 helix from the first HIV-1 strain. In additional embodiments, the N- and C-terminal regions of the gp120 polypeptide comprise gp120 positions 31-45 and 478-508, respectively. the gp120 polypeptide can further comprises positions 46-54, 70-75, 84-89, 99, 102, 106, 107, 114, 215, 220-224, 226, 244, 471-473, and 476-477 from the first HIV-1 strain. The sequences of the first, second, and heterologous strains are further modified to comprise the one or more amino acid substitutions that stabilize the recombinant HIV-1 Env ectodomain trimer in the prefusion mature closed conformation.

In some embodiments, the second and heterologous strains are respectively one of: CAP256.SU and 426c; BB201.B42 and 426c; KER2018.11 and 426c; CH070.1 and 426c; ZM233.6 and 426c; Q23.17 and 426c; A244 and 426c; T250-4 and 426c; WITO.33 and 426c; CAP256.SU and 45_01dG5; BB201.B42 and 45_01dG5; KER2018.11 and 45_01dG5; CH070.1 and 45_01dG5; ZM233.6 and 45_01dG5; Q23.17 and 45_01dG5; A244 and 45_01dG5; T250-4 and 45_01dG5; or WITO.33 and 45_01dG5; and wherein the 426c strain further comprises amino acid substitutions to remove the N-linked glycan sequons at positions 276, 460, 463. The sequences of the first, second, and heterologous strains are further modified to include the one or more amino acid substitutions that stabilize the recombinant HIV-1 Env ectodomain trimer in the prefusion mature closed conformation (such as SOS, IP, and DS substitutions), and can also include additional substitutions as needed, In some embodiments, the second HIV-1 strain (providing the V1V2 domain) can be one of BI369.9A, MB201.A1, QH209.14M.A2, 0921.V2.C14, 16055-2.3, 25925-2.22, 286.36, CAP45.G3, DU156.12, DU422.01, MW965.26, ZM53.12, ZM55.28a, ZM106.9, 3301.V1.C24, 6545.V4.C1, 620345.c1, C1080.c3, C4118.09, CNE55, TH966.8, AC10.29, CH038.12, CNE58, CH117.4, CAP256.SU, BB201.B42, KER2018.11, CH070.1, ZM233.6, Q23.17, A244, T250-4, WITO.33, or JRFL. For example, the second HIV-1 strain can be one of CAP256.SU, BB201.B42, KER2018.11, CH070.1, ZM233.6, Q23.17, A244, T250-4, WITO.33, and JRFL.

Non-limiting examples of sequences of such chimeric HIV-1 Env ectodomains (that may also include one or more amino acid substitutions, such as 201C/433C and SOSIP substitutions to stabilize the HIV-1 ectodomain in the prefusion mature closed conformation) are provided herein as SEQ ID NOs: 2146-2159. Thus, in some embodiments, the recombinant HIV-1 Env protein includes an amino acid sequence set forth as any one of SEQ ID NOs: 2146, 2147, 2148, 2149, 2150, 2151, 2152, 2153, 2154, 2155, 2156, 2157, 2158, or 2159, or an amino acid sequence at least 80% (such as at least 90%, at least 95%, at least 96%, at least 97%, at least 98%, or at least 99%) identical to any one of SEQ ID NOs: 2146, 2147, 2148, 2149, 2150, 2151, 2152, 2153, 2154, 2155, 2156, 2157, 2158, or 2159.

Residue Set B

In more embodiments, the gp120 portion of the recombinant HIV-1 Env ectodomain (from the heterologous HIV-1 strain) can include additional substitutions to alter the antigenicity of the ectodomain. In some embodiments, the substitutions at the gp120-gp41 interface that introduce residues from the first HIV-1 strain can include substitutions at gp120 positions 133-134, 164, 169, 308, and 316 (referred to herein as "Residue Set B"). In some embodiments, the recombinant HIV-1 Env ectodomain includes gp120 residues 31-45 and 478-507, and gp41 residues (e.g., 512-664), from a first HIV-1 strain (such as the BG505 strain with SOSIP substitutions set forth as SEQ ID NO: 3), and includes gp120 residues 46-477 from a heterologous strain of HIV-1 (such as the CAP256.SU, BB201.B42, KER2018.11, CH070.1, ZM233.6, Q23.17, A244, WITO.33, BI369.9A, MB201.A1, QH209.14M.A2, 0921.V2.C14, 16055-2.3, 25925-2.22, 286.36, CAP45.G3, CNE58, DU156.12, DU422.01, MW965.26, ZM53.12, ZM55.28a, ZM106.9, 3301.V1.C24, 6545.V4.C1, 620345.c1, C1080.c3, C4118.09, CNE55, TH966.8, AC10.29, CH038.12, or CH117.4 strain of HIV-1), and further includes substitutions in the gp120 residues from the heterologous strain that introduce residues from the first HIV-1 strain at the Residue Set B positions of gp120. Non-limiting examples of sequences of such chimeric HIV-1 Env ectodomains (that may also include one or more amino acid substitutions, such as 201C/433C and SOSIP substitutions to stabilize the HIV-1 ectodomain in the prefusion mature closed conformation) are provided herein as SEQ ID NOs: 1114-1142. Thus, in some embodiments, the recombinant HIV-1 Env protein includes an amino acid sequence set forth as any one of SEQ ID NOs: 1114-1142, or an amino acid sequence at least 80% (such as at least 90%, at least 95%, at least 96%, at least 97%, at least 98%, or at least 99%) identical to any one of SEQ ID NOs: 1114-1142.

Residue Set C

In more embodiments, the gp120 portion of the recombinant HIV-1 Env ectodomain (from the heterologous HIV-1 strain) can include additional substitutions to alter the antigenicity of the ectodomain. In some embodiments, the substitutions at the gp120-gp41 interface that introduce residues from the first HIV-1 strain can include substitutions at gp120 positions 49, 133-134, 149-152, 164, 169, 188, 190, 211, 223, 252, 281, 293, 308, 316, 336, 340, 352, 360, 362-363, 369, 372, 393, 410, 432, 442, 444, 446, 474, and 476 (referred to herein as "Residue Set C"). In some embodiments, the recombinant HIV-1 Env ectodomain includes gp120 residues 31-45 and 478-507, and gp41 residues (e.g., 512-664), from a first HIV-1 strain (such as the BG505 strain with SOSIP substitutions set forth as SEQ ID NO: 3), and includes gp120 residues 46-477 from a heterologous strain of HIV-1 (such as the CAP256.SU, BB201.B42, KER2018.11, CH070.1, ZM233.6, Q23.17, A244, WITO.33, BI369.9A, MB201.A1, QH209.14M.A2, 0921.V2.C14, 16055-2.3, 25925-2.22, 286.36, CAP45.G3, CNE58, DU156.12, DU422.01, MW965.26, ZM53.12, ZM55.28a, ZM106.9, 3301.V1.C24, 6545.V4.C1, 620345.c1, C1080.c3, C4118.09, CNE55, TH966.8, AC10.29, CH038.12, or CH117.4 strain of HIV-1), and further includes substitutions in the gp120 residues from the heterologous strain that introduce residues from the first HIV-1 strain at the Residue Set C positions of gp120. Non-limiting examples of sequences of such chimeric HIV-1 Env ectodomains (that may also include one or more amino acid substitutions, such as 201C/433C and SOSIP substitutions to stabilize the HIV-1 ectodomain in the prefusion mature closed conformation) are provided herein as SEQ ID NOs: 1143-1171. Thus, in some embodiments, the recombinant HIV-1 Env protein includes an amino acid sequence set forth as any one of SEQ ID NOs: 1143-1171, or an amino acid sequence at least 80% (such as at least 90%, at least 95%, at least 96%, at least 97%, at least 98%, or at least 99%) identical to any one of SEQ ID NOs: 1143-1171.

Residue Set D

In more embodiments, the gp120 portion of the recombinant HIV-1 Env ectodomain (from the heterologous HIV-1 strain) can include additional substitutions to alter the antigenicity of the ectodomain. In some embodiments, the substitutions at the gp120-gp41 interface that introduce residues from the first HIV-1 strain can include substitutions at gp120 positions of Residue Set C and also gp120 positions 46, 60, 62-63, 84-85, 87, 99, 102, 130, 132, 135, 153, 158, 160-161, 165-167, 171-173, 175, 177-178, 181, 184-185, 189, 202, 232, 234, 236, 240, 268-271, 275, 277, 287, 289, 292, 295, 297, 305, 315, 317, 319, 322, 328, 330, 332-335, 337, 339, 343-347, 350-351,357, 371, 375, 379, 387, 389, 394, 411, 412-413, 415, 424, 426, 429, 440, 460-461, 465, 475, and 477 (referred to herein as "Residue Set D"). In some embodiments, the recombinant HIV-1 Env ectodomain includes gp120 residues 31-45 and 478-507, and gp41 residues (e.g., 512-664), from a first HIV-1 strain (such as the BG505 strain with SOSIP substitutions set forth as SEQ ID NO: 3), and includes gp120 residues 46-477 from a heterologous strain of HIV-1 (such as the CAP256.SU, BB201.B42, KER2018.11, CH070.1, ZM233.6, Q23.17, A244, WITO.33, BI369.9A, MB201.A1, QH209.14M.A2, 0921.V2.C14, 16055-2.3, 25925-2.22, 286.36, CAP45.G3, CNE58, DU156.12, DU422.01, MW965.26, ZM53.12, ZM55.28a, ZM106.9, 3301.V1.C24, 6545.V4.C1, 620345.c1, C1080.c3, C4118.09, CNE55, TH966.8, AC10.29, CH038.12, or CH117.4 strain of HIV-1), and further includes substitutions in the gp120 residues from the heterologous strain that introduce residues from the first HIV-1 strain at the Residue Set C and Residue Set D positions of gp120. Non-limiting examples of sequences of such chimeric HIV-1 Env ectodomains (that may also include one or more amino acid substitutions, such as 201C/433C and SOSIP substitutions to stabilize the HIV-1 ectodomain in the prefusion mature closed conformation) are provided herein as SEQ ID NOs: 1172-1200. Thus, in some embodiments, the recombinant HIV-1 Env protein includes an amino acid sequence set forth as any one of SEQ ID NOs: 1172-1200, or an amino acid sequence at least 80% (such as at least 90%, at least 95%, at least 96%, at least 97%, at least 98%, or at least 99%) identical to any one of SEQ ID NOs: 1172-1200.

Additional Substitutions

The chimeric recombinant HIV-1 Env ectodomain can be mutated to include one or more of the disclosed amino acid substitutions to generate a chimeric recombinant HIV Env protein (or fragment thereof, such as a gp140 or gp145 protein) that is stabilized in a prefusion mature closed conformation. For example, in some non-limiting embodiments, cysteine substitutions at positions 201 and 433, and the SOSIP mutations, are made to a recombinant HIV-1 Env ectodomain including a V1V2 domain from a CAP256.SU, BB201.B42, KER2018.11, CH070.1, ZM233.6, Q23.17, A244, T250-4, or WITO.33 strain of HIV-1 to generate the recombinant HIV-1 Env ectodomain that can form a trimer stabilized in the prefusion mature closed conformation. In some embodiments, the N-terminal residue of the transplanted V1V2 domain can include one of Env positions 120-130 and the C-terminal residue of the transplanted V1V2 domain can include one of Env positions 195-205. In one non-limiting example, the transplanted V1V2 domain includes HIV-1 Env positions 126-196. Exemplary sequences of HIV-1 ectodomains including a transplanted V1V2 domain are provided under code H of the Table in Table 13 and as SEQ ID NOs: 379-386, or 511-518.

Sequences from additional HIV-1 strains (such as a third, fourth or fifth strain) can be incorporated into the chimeric HIV-1 Env ectodomain. For example, any of the chimeric HIV-1 Env ectodomains disclosed herein can be further modified to include all or portions of the V1V2 domain (such as strand C of the V1V2 domain, for example, HIV-1 Env positions 166-173) from a heterologous HIV-1 strain (such as CAP256 SU). In a non-limiting embodiment, SEQ ID NO: 382 (CNE58_SU-strandC_bg505-NCgp120+ gp41.SOSIP) provided herein includes gp41 and gp120 N- and C-terminal regions (31-45 and 478-507, respectively) from BG505.SOSIP.664, with residues 166-173 (V1V2 strand C) from CAP256 SU, and the rest of gp120 from CNE58.

Any of the chimeric HIV-1 Env ectodomain trimers provided herein can comprise gp120-gp41 protomers that are single chain Env ectodomains, including a single polypeptide chain including the gp120 polypeptide linked to the gp41 ectodomain by a heterologous peptide linker.

In some embodiments, the gp120/gp41 protomers in the chimeric HIV-1 Env ectodomain can comprise an amino acid sequence set forth as any one of SEQ ID NOs: 1580-1610, 1648-1650, 1657-1659, 1663-1673, 1676-2098, or an amino acid sequence at least 90% identical thereto.

In any of the disclosed embodiments that include a chimeric V1V2 domain, the V1V2 domain can comprise or consist of gp120 positions 126-196 (HXB2 numbering).

Single Chain HIV-1 Env Proteins

In some embodiments, the recombinant HIV-1 Env ectodomain is a single chain HIV-1 Env protein, which includes a single polypeptide chain including the gp120 polypeptide and the gp41 ectodomain. Native HIV-1 Env sequences include a furin cleavage site at position 511 (e.g., $REKR_{511}$), which is cleaved by a cellular protease to generate the gp120 and gp41 polypeptides. The disclosed single chain proteins do not include the furin cleavage site separating the gp120 and gp41 polypeptides; therefore, when produced in cells, the Env polypeptide is not cleaved into separate gp120 and gp41 polypeptides.

Single chain HIV-1 proteins can be generated by mutating the furin cleavage site to prevent cleave and formation of separate gp120 and gp41 polypeptide chains. In several embodiments, the gp120 and gp41 polypeptides in the single chain HIV-1 Env protein are joined by a linker, such as a peptide linker. Examples of peptide linkers that can be used include glycine, serine, and glycine-serine linkers, such as a G, S, GG, GS, SG, GGG, or GSG linker or any of the linkers set forth as SEQ ID NOs: 519-542. In some embodiments, the peptide linker can comprise a 10 amino acid glycine-serine peptide linker, such as a peptide linker comprising the amino acid sequence set forth as SEQ ID NOs: 528 (GGSGGGGSGG). In some embodiments, the single chain HIV-1 protein can include a heterologous peptide linker between one of HIV-1 Env residues 507 and 512, 503 and 519, 504 and 519, 503 and 522, or 504 and 522. In some embodiments, the single chain HIV-1 protein can include a heterologous peptide linker between HIV-1 Env residues 507 and 512.

Any amino acid substitution or insertion can be used that effectively prevents furin (or other protease) cleavage of HIV-1 Env into separate gp120 and gp41 polypeptide chains, and also allows folding of the HIV-1 Env ectodomain into its prefusion mature closed conformation.

Any of the stabilizing mutations (or combinations thereof) disclosed herein can be included in the single chain HIV-1 Env protein as long as the single chain HIV-1 Env protein retains the HIV-1 Env prefusion mature closed conformation. For example, in some embodiments, the single chain HIV-1 Env protein can include cysteine substitutions at positions 201 and 433 that form a disulfide bond and one or more of the pairs of cysteine substitutions listed in Table 9, or the single chain HIV-1 Env protein can include cysteine substitutions at positions 201 and 433 that form a disulfide bond and further include the SOSIP mutations.

It will be appreciated that the single chain HIV-1 Env proteins can be incorporated into any embodiment disclosed herein in which the cleaved HIV-1 Env proteins can be used. For example, the single chain HIV-1 Env proteins can be linked to a protein nanoparticle subunit to generate a protein nanoparticle including the single chain Env protein, and can also be used in the context of a chimeric HIV-1 Env ectodomain including sequences from two or more different strains of HIV-1.

Exemplary single chain HIV-1 Env sequences are provided under code B of the Table in Table 13 and set forth as SEQ ID NOs: 210-408. Additional exemplary single chain chimeric HIV-1 Env ectodomain sequences are indicated as such in column 7 of the tables in Table 13, and also provides as SEQ ID NOs: 1078-1098, and 1643-1650.

Membrane Anchored Embodiments

In some embodiments, the recombinant HIV-1 Env ectodomain is a membrane anchored protein, for example, the recombinant Env ectodomain can be linked to a transmembrane domain. The transmembrane domain can be linked to any portion of the recombinant HIV-1 Env ectodomain, as long as the presence of the transmembrane domain does not disrupt the structure of the HIV-1 Env ectodomain, or its ability to induce an immune response to HIV-1. In non-limiting examples, the transmembrane domain can be linked to the N- or C-terminal reside of a gp120 polypeptide, or the C-terminal residue of a gp41 ectodomain included in the recombinant HIV-1 Env protein. In some embodiments, the C-terminal residue of the gp41 ectodomain included in the recombinant HIV-1 Env ectodomain can be linked to the transmembrane domain. One or more peptide linkers (such as a gly-ser linker, for example a 10 amino acid glycine-serine peptide linker, such as a peptide linker comprising the amino acid sequence set forth as SEQ ID NOs: 528 (GGSGGGGSGG)) can be used to link the transmembrane domain and the gp120 or gp41 protein. In some embodiments a native HIV-1 Env MPER sequence can be used to link the transmembrane domain and the gp120 or gp41 protein.

Non-limiting examples of transmembrane domains for use with the disclosed embodiments include the BG505 TM domain (KIFIMIVGGLIGLRIVFAVLSVIHRVR, SEQ ID NO: 758), the Influenza A Hemagglutinin TM domain (ILAIYSTVASSLVLLVSLGAISF, SEQ ID NO: 760, and the Influenza A Neuraminidase TM domain (IITIGSICMV-VGIISLILQIGNIISIWVS, SEQ ID NO: 762). Nucleic acid sequences encoding these TM domains are provided as SEQ ID NOs: 759, 761, and 763, respectively.

The recombinant HIV-1 Env ectodomain linked to the transmembrane domain can include any of the stabilizing mutations provided herein. For example, the transmembrane domain can be linked to the C-terminal residue of a gp41 ectodomain included in a recombinant HIV-1 Env ectodomain including the DS substitutions (I201C/A433C), and/or can be linked to any of the disclosed chimeric recombinant HIV-1 Env ectodomains.

Exemplary sequences of recombinant HIV-1 Env ectodomain (or a fragment thereof) linked to a transmembrane domain and including amino acid substitutions to stabilize the ectodomain in the prefusion mature closed conformation are provided under code T of the Table in Table 13, and as SEQ ID NOs: 544-571, and 1765-2098.

Linkage to a Trimerization Domain

In several embodiments, the recombinant HIV-1 Env ectodomain can be linked to a trimerization domain, for example the C-terminus of the gp41 protein included in the recombinant HIV-1 Env ectodomain can be linked to the trimerization domain. The trimerization domain can promotes trimerization of the three protomers of the recombinant HIV-1 Env protein. Non-limiting examples of exogenous multimerization domains that promote stable trimers of soluble recombinant proteins include: the GCN4 leucine zipper (Harbury et al. 1993 *Science* 262:1401-1407), the trimerization motif from the lung surfactant protein (Hoppe et al. 1994 *FEBS Lett* 344:191-195), collagen (McAlinden et al. 2003 *J Biol Chem* 278:42200-42207), and the phage T4 fibritin Foldon (Miroshnikov et al. 1998 *Protein Eng* 11:329-414), any of which can be linked to the recombinant HIV-1 Env ectodomain (e.g., by linkage to the C-terminus of the gp41 polypeptide to promote trimerization of the recombinant HIV-1 protein, as long as the recombinant HIV-1 Env ectodomain retains specific binding activity for a mature closed conformation specific antibody, prefusion-specific antibody (e.g., PGT122), and/or includes a HIV-1 Env mature closed conformation.

In some examples, the recombinant HIV-1 Env ectodomain can be linked to a Foldon domain, for example, the recombinant HIV-1 Env ectodomain can include a gp41 polypeptide with a Foldon domain linked to its C-terminus. In specific examples, the Foldon domain is a T4 fibritin Foldon domain such as the amino acid sequence GYI-PEAPRDGQAYVRKDGEWVLLSTF (SEQ ID NO: 578), which adopts a β-propeller conformation, and can fold and trimerize in an autonomous way (Tao et al. 1997 *Structure* 5:789-798). Modified Foldon domains can also be used, such as a Foldon domain including an amino acid sequence set forth as GYIPEAPRDGQCYVRCDGEWVLLSTF (SEQ ID NO: 752), GYIPECPRDGQAYVCKDGEWVLL-STF (SEQ ID NO: 753), GYIPEAPRDGQCY-CRKDGEWVLLSTF (SEQ ID NO: 754), or GYI-PEAPRDGQACVRKDGECVLLSTF (SEQ ID NO: 755). These modified Foldon domains include amino acid substitutions that add two cysteine residues for formation of stabilizing disulfide bonds. In some embodiments, any of the disclosed recombinant HIV-1 Env ectodomains can be linked to a modified Foldon domain as described herein.

Exemplary sequences of recombinant HIV-1 Env ectodomain linked to a trimerization domain are provided under code G of the Table in Table 13, and as SEQ ID NOs: 508-510.

Typically, the heterologous trimerization domain is positioned C-terminal to the gp41 polypeptide. Optionally, the multimerization domain is connected to the recombinant HIV-1 Env ectodomain via a linker, such as an amino acid linker. Exemplary linkers are provided herein and are known in the art; non-limiting examples include Gly or Gly-Ser linkers, such as the amino acid sequence: GGSGGSGGS; SEQ ID NO: 574). Numerous conformationally neutral linkers are known in the art that can be used in this context without disrupting the conformation of the recombinant HIV-1 Env protein. Some embodiments include a protease cleavage site for removing the trimerization domain from the HIV polypeptide, such as, but not limited to, a thrombin site between the recombinant HIV-1 Env ectodomain and the trimerization domain.

Additional Descriptions of Recombinant HIV-1 Env Ectodomains

Any of the recombinant HIV-1 Env ectodomains disclosed herein can further include an N-linked glycosylation site at gp120 position 332 (if not already present on the ectodomain). For example, by T332N substitution in the case of BG505 based immunogens. The presence of the glycosylation site at N332 allows for binding by 2G12 antibody.

Any of the recombinant HIV-1 Env ectodomains disclosed herein can include a lysine residue at gp120 position 168 (if not already present on the ectodomain). For example, the lysine residue can be added by amino acid substitution (such as an E168K substitution in the case of the JR-FL based immunogens). The presence of the lysine residue at position 168 allows for binding of particular broadly neutralizing antibodies to the V1V2 loop of gp120.

Any of the recombinant HIV-1 Env ectodomains disclosed herein can include an arginine residue at gp120 position 368 (if not already present on the ectodomain). For example, the arginine residue can be added by amino acid substitution (such as a D368R substitution). The presence of the arginine residue at position 368 reduces binding of CD4 to the HIV-1 Env ectodomain to inhibit the trimer from adopting the CD4-bound conformation.

Any of the recombinant HIV-1 Env ectodomains disclosed herein can further include a non-natural disulfide bond between gp120 positions 201 and 433 (if not already present on the ectodomain). For example, the non-natural disulfide bond can be introduced by including cysteine substitutions at positions 201 and 433. The presence of the non-natural disulfide bond between residues 201 and 433 contributes to the stabilization of the HIV-1 Env ectodomain in the prefusion mature closed conformation.

Any of the recombinant HIV-1 Env ectodomains disclosed herein can further include a non-natural disulfide bond between HIV-1 Env positions 501 and 605 (if not already present on the ectodomain). For example, the non-natural disulfide bond can be introduced by including cysteine substitutions at positions 501 and 605. The presence of the non-natural disulfide bond between positions 501 and 605 contributes to the stabilization of the HIV-1 Env ectodomain in the prefusion mature closed conformation.

Any of the recombinant HIV-1 Env ectodomains disclosed herein can further include a proline residue at HIV-1 Env positions 559 (if not already present on the ectodomain). For example, the proline residue can be introduced at position 559 by amino acid substitution (such as an I559P substitution). The presence of the proline residue at position 559 contributes to the stabilization of the HIV-1 Env ectodomain in the prefusion mature closed conformation.

Any of the recombinant HIV-1 Env ectodomains disclosed herein can further include a non-natural disulfide bond between HIV-1 Env positions 501 and 605 and a proline residue at HIV-1 Env positions 559 (if not already present on the ectodomain). For example, the non-natural disulfide bond can be introduced by including cysteine substitutions at positions 501 and 605, and the proline residue can be introduced at position 559 by amino acid substitution (such as an I559P substitution). The presence of the non-natural disulfide bond between positions 501 and 605 and the proline residue at position 559 contributes to the stabilization of the HIV-1 Env ectodomain in the prefusion mature closed conformation.

Any of the recombinant HIV-1 Env ectodomains disclosed herein can be further modified to be a singly chain HIV-1 Env ectodomain including a 10 amino acid glycine serine linker between HIV-1 Env residues 507 and 512 (if the recombinant HIV-1 Env ectodomains is not already a single chain ectodomain).

Any of the recombinant HIV-1 Env ectodomains disclosed herein can be further modified to include the "R6" mutation, which provides six Arginine residues in place of the naïve furin cleavage site between gp120 and gp41.

Any of the soluble recombinant HIV-1 Env ectodomain trimers disclosed herein can include mutations to add a N-linked glycan sequon at position 504, position 661, or positions 504 and 661, to increase glycosylation of the membrane proximal region of the ectodomain.

Any of the recombinant HIV-1 Env ectodomain trimers disclosed herein that include a protease cleavage site between the gp120 and gp41 polypeptides can be modified to be a single chain HIV-1 Env ectodomain by mutation of the protease cleavage site for example by introducing a 10 amino acid linker connecting gp120 and gp41 or a 15 amino acid linker connecting g120 and gp41, for example as shown in SEQ ID NOs: 2158 (15 AA linker) and 2159 (10 AA linker).

In some embodiments, the recombinant HIV-1 Env ectodomain can comprise a circular permutant of the Env ectodomain. For example, the circular permutant can comprise, from N-terminus to C-terminus, (A) the gp41 polypeptide and the gp120 polypeptide linked by a peptide linker or directly linked; or (B) a first segment of the gp41 polypeptide comprising a α6 helix, a α7 helix, and/or a 127 strand of the prefusion mature closed conformation of the HIV-1 Env protein;

the gp120 polypeptide; and a second segment of the gp41 polypeptide comprising the α8 helix and/or the α9 helix of the prefusion mature closed conformation, wherein the first and second segments of the gp41 polypeptide are linked to the gp120 polypeptide by a peptide linker, or are directly linked to the gp120 polypeptide.

The recombinant HIV-1 Env ectodomain comprising the circular permutant of the Env ectodomain can further comprise any of the amino acid substitutions disclosed herein for stabilizing the HIV-1 Env ectodomain in the prefusion mature closed conformation, such as the DS-SOSIP substitutions.

C. V1V2V3 Immunogens

The V1, V2, and V3 domains of HIV-1 Env are located on the apex of the trimer in the prefusion mature closed conformation and include regions recognized by several neutralizing antibodies. Provided herein are immunogens that include these minimal domains of the HIV-1 Env protein in a format that maintains their structure in the prefusion mature closed conformation, and which are useful, for example, for inducing an immune response to HIV-1 Env. These immunogens are also useful for specific binding to antibodies that target the V1, V2, or V3 domains of HIV-1 Env, for example as probes to identify or detect such antibodies.

In several embodiments, the V1, V2, and V3 domains are included on a protein scaffold, such as a scaffold protein based on the 1VH8 protein (SEQ ID NO: 855), which is deposited in the Protein Data Bank as No. 1VH8, and incorporated by reference herein in its entirety. In another example, the "scaffold" can be any of the recombinant HIV-1 ectodomain trimers described herein, and the V1V2V3 immunogen can be included on the recombinant HIV-1 ectodomain trimer in place of the corresponding sequence of thHIV-1 ectodomain (e.g., the V1V2V3 immunogen can be "transplanted" on the recombinant HIV-1 ectodomain trimer). In some embodiments, the V1V2V3 scaffold protein comprises a circular permutant of the V1, V2, and V3 domains of HIV-1 linked to the 1VH8 protein. In some embodiments, the V1V2V3 scaffold protein comprises from N- to C-terminus:

(1VH8 residues 36-159)-$L_1$-(1VH8 residues 2-15)-$L_2$-(V1V2 domain)-$L_3$-(V3 domain)

In some embodiments, the V1V2 domain portion of the V1V2V3 scaffold protein can include HIV-1 Env residues 120-203. In some embodiments, the V3 domain portion of the V1V2V3 scaffold protein can be a circular permutant of the V3 domain including, from N- to C-terminus, (HIV-1 Env residues 317-330)-$L_4$-(HIV-1 Env residues 297-314)

The linkers in the V1V2V3 scaffold protein are peptide linkers, for example glycine-serine linkers. In some embodiments, the $L_1$ linker can include a GSG sequence, the $L_2$ linker can include SEQ ID NO: 528 or SEQ ID NO: 854, the $L_3$ linker can include SEQ ID NO: 319, and/or the $L_4$ linker can include AA-GSG-A.

Exemplary V1V2V3 scaffold proteins are provided as SEQ ID NOs: 836-843. In some embodiments, the immunogen includes an amino acid sequence at least 80% (such as at least 90%, at least 95%, at least 96%, at least 97%, at least 98%, or at least 99%) identical to any one of SEQ ID NOs: 836-843.

The V1V2V3 scaffold protein can include any of the stabilizing mutations described herein that include mutations to the V1, V2, and/or V3 domain to stabilize the V1, V2, and/or V3 domains in the prefusion mature closed conformation of the HIV-1 Env protein, for example the V1V2V3 scaffold protein can include cysteine substitutions at positions 174 and 319, or 175 and 320, which stabilize the V1, V2 and/or V3 domains in the prefusion mature closed conformation.

D. Protein Nanoparticles

In some embodiments a protein nanoparticle is provided that includes one or more of the disclosed recombinant HIV-1 Env ectodomains stabilized in a prefusion mature closed conformation, or an immunogenic fragment thereof. Such a protein nanoparticle can be specifically bound by one or more antibodies that specifically bind to the HIV-1 Env prefusion mature closed conformation, such as VRC26, PGT122, PGT145, and 35O22. Additionally, in several embodiments, the disclosed nanoparticles do not specifically bind to an antibody that specifically binds to HIV-1 Env in its CD4 bound conformation, but not to HIV-1 Env in its prefusion mature closed conformation. For example, the disclosed protein nanoparticles do not specifically bind to 17b antibody in the presence of a molar excess of CD4. Non-limiting example of nanoparticles include ferritin nanoparticles, an encapsulin nanoparticles, Sulfur Oxygenase Reductase (SOR) nanoparticles, and lumazine synthase nanoparticles, which are comprised of an assembly of monomeric subunits including ferritin proteins, encapsulin proteins, SOR proteins, and lumazine synthase respectively. Exemplary sequences of recombinant HIV-1 Env ectodomains linked to a nanoparticle subunit are provided under code F in the Table included in Table 13. To construct protein nanoparticles including a HIV-1 Env proteins stabilized in a prefusion mature closed conformation or immunogenic fragment thereof, the HIV-1 Env protein or fragment can be linked to a subunit of the protein nanoparticle (such as a ferritin protein, an encapsulin protein, a SOR protein, or a lumazine synthase protein). The fusion protein self-assembles into a nanoparticle under appropriate conditions.

In several embodiments, the protein nanoparticle comprises two or more of the recombinant HIV-1 Env proteins, wherein the two or more recombinant HIV-1 Env proteins are from at least two different strains of HIV-1.

In some embodiments, the immunogen comprises a recombinant HIV-1 Env protein linked to a protein nanoparticle subunit, and comprises an amino acid sequence at least 80% (such as at least 90%, at least 95%, at least 96%, at least 97%, at least 98%, or at least 99%) identical to the sequence set forth as one of 471-507, or 596-645, wherein the recombinant HIV-1 Env protein linked to the nanoparticle subunit can oligomerizes to form a functional protein nanoparticle including a recombinant HIV-1 Env ectodomain trimer (or immunogenic fragment thereof) in a prefusion mature closed conformation.

In some embodiments, a disclosed recombinant HIV-1 Env ectodomain stabilized in a prefusion mature closed conformation or immunogenic fragment thereof can be linked to a ferritin subunit to construct a ferritin nanoparticle. Ferritin nanoparticles and their use for immunization purposes (e.g., for immunization against influenza antigens) have been disclosed in the art (see, e.g., Kanekiyo et al., Nature, 499:102-106, 2013, incorporated by reference herein in its entirety). Ferritin is a globular protein that is found in all animals, bacteria, and plants, and which acts primarily to control the rate and location of polynuclear $Fe(III)_2O_3$ formation through the transportation of hydrated iron ions and protons to and from a mineralized core. The globular form of the ferritin nanoparticle is made up of monomeric subunits, which are polypeptides having a molecule weight of approximately 17-20 kDa. An example of the amino acid sequence of one such monomeric subunit is represented by SEQ ID NO: 575.

Each monomeric subunit has the topology of a helix bundle which includes a four antiparallel helix motif, with a fifth shorter helix (the c-terminal helix) lying roughly perpendicular to the long axis of the 4 helix bundle. According to convention, the helices are labeled 'A, B, C, D & E' from the N-terminus respectively. The N-terminal sequence lies adjacent to the capsid three-fold axis and extends to the surface, while the E helices pack together at the four-fold axis with the C-terminus extending into the capsid core. The consequence of this packing creates two pores on the capsid surface. It is expected that one or both of these pores represent the point by which the hydrated iron diffuses into and out of the capsid. Following production, these monomeric subunit proteins self-assemble into the globular ferritin protein. Thus, the globular form of ferritin comprises 24 monomeric, subunit proteins, and has a capsid-like structure having 432 symmetry. Methods of constructing ferritin nanoparticles are known to the person of ordinary skill in the art and are further described herein (see, e.g., Zhang, *Int. J. Mol. Sci.,* 12:5406-5421, 2011, which is incorporated herein by reference in its entirety).

In specific examples, the ferritin polypeptide is *E. coli* ferritin, *Helicobacter pylori* ferritin, human light chain ferritin, bullfrog ferritin or a hybrid thereof, such as *E. coli*-human hybrid ferritin, *E. coli*-bullfrog hybrid ferritin, or human-bullfrog hybrid ferritin. Exemplary amino acid sequences of ferritin polypeptides and nucleic acid sequences encoding ferritin polypeptides for use to make a ferritin nanoparticle including a recombinant HIV-1 Env ectodomain or immunogenic fragment thereof can be found in GENBANK®, for example at accession numbers ZP_03085328, ZP_06990637, EJB64322.1, AAA35832, NP_000137 AAA49532, AAA49525, AAA49524 and AAA49523, which are specifically incorporated by reference herein in their entirety as available Jun. 20, 2014. In some embodiments, a disclosed recombinant HIV-1 Env ectodomain stabilized in a prefusion mature closed conformation or immunogenic fragment thereof can be linked to a ferritin subunit including an amino acid sequence at least 80% (such as at least 90%, at least 95%, at least 96%, at least 97%, at least 98%, or at least 99%) identical to amino acid sequence set forth as SEQ ID NO: 575.

Non-limiting examples of a recombinant HIV-1 Env ectodomains stabilized in a prefusion mature closed conformation or immunogenic fragments thereof linked to a ferritin subunit include the amino acid sequence set forth as any one of SEQ ID NO: 471, 473-475, 626-637, 797-802, 809-814, 821-835, 1099-1113, and 1201-1218.

In additional embodiments, any of the disclosed recombinant HIV-1 Env proteins stabilized in a prefusion mature closed conformation or immunogenic fragments thereof can be linked to a lumazine synthase subunit to construct a lumazine synthase nanoparticle. The globular form of lumazine synthase nanoparticle is made up of monomeric subunits; an example of the sequence of one such monomeric subunit is provides as the amino acid sequence set forth as SEQ ID NO: 576.

In some embodiments, a disclosed recombinant HIV-1 Env ectodomain stabilized in a prefusion mature closed conformation or immunogenic fragment thereof can be linked to a lumazine synthase subunit including an amino acid sequence at least 80% (such as at least 90%, at least 95%, at least 96%, at least 97%, at least 98%, or at least 99%) identical to amino acid sequence set forth as SEQ ID NO: 576. Specific examples of a recombinant HIV-1 Env ectodomain stabilized in a prefusion mature closed conformation or immunogenic fragments thereof linked to a lumazine synthase subunit is provided as the amino acid sequence set forth as SEQ ID NO: 472, 476-477, 638-645, 803-808, and 815-820.

In additional embodiments, a disclosed recombinant HIV-1 Env ectodomain stabilized in a prefusion mature closed conformation or immunogenic fragment thereof can be linked to an encapsulin subunit to construct an encapsulin nanoparticle. The globular form of the encapsulin nanoparticle is made up of monomeric subunits; an example of the sequence of one such monomeric subunit is provides as the amino acid sequence set forth as SEQ ID NO: 756.

In some embodiments, a disclosed recombinant HIV-1 Env ectodomain stabilized in a prefusion mature closed conformation or immunogenic fragment thereof can be linked to an encapsulin subunit including an amino acid sequence at least 80% (such as at least 90%, at least 95%, at least 96%, at least 97%, at least 98%, or at least 99%) identical to amino acid sequence set forth as SEQ ID NO: 756.

Encapsulin proteins are a conserved family of bacterial proteins also known as linocin-like proteins that form large protein assemblies that function as a minimal compartment to package enzymes. The encapsulin assembly is made up of monomeric subunits, which are polypeptides having a molecule weight of approximately 30 kDa. Following production, the monomeric subunits self-assemble into the globular encapsulin assembly including 60 monomeric subunits. Methods of constructing encapsulin nanoparticles are known to the person of ordinary skill in the art, and further described herein (see, for example, Sutter et al., *Nature Struct. and Mol. Biol.,* 15:939-947, 2008, which is incorporated by reference herein in its entirety). In specific examples, the encapsulin polypeptide is bacterial encapsulin, such as *E. coli* or *Thermotoga* maritime encapsulin.

In additional embodiments, a disclosed recombinant HIV-1 Env ectodomain stabilized in a prefusion mature closed conformation or immunogenic fragment thereof can be linked to a Sulfer Oxygenase Reductase (SOR) subunit to construct a recombinant SOR nanoparticle. In some embodiments, the SOR subunit can include the amino acid sequence set forth as SEQ ID NO: 577.

In some embodiments, a disclosed recombinant HIV-1 Env ectodomain stabilized in a prefusion mature closed conformation or immunogenic fragment thereof can be linked to a SOR subunit including an amino acid sequence at least 80% (such as at least 90%, at least 95%, at least 96%, at least 97%, at least 98%, or at least 99%) identical to amino acid sequence set forth as SEQ ID NO: 577.

SOR proteins are microbial proteins (for example from the thermoacidophilic archaeon *Acidianus ambivalens* that form 24 subunit protein assemblies. Methods of constructing SOR nanoparticles are known to the person of ordinary skill in the art (see, e.g., Urich et al., Science, 311:996-1000, 2006, which is incorporated by reference herein in its entirety). An example of an amino acid sequence of a SOR protein for use to make SOR nanoparticles is set forth in Urich et al., Science, 311:996-1000, 2006, which is incorporated by reference herein in its entirety.

In some examples, the disclosed recombinant HIV-1 Env ectodomain stabilized in a prefusion mature closed conformation or immunogenic fragment thereof can be linked to the N- or C-terminus, or placed within an internal loop of a ferritin, encapsulin, SOR, or lumazine synthase subunit, for example with a linker, such as a Ser-Gly linker. When the constructs have been made in HEK 293 Freestyle cells, the fusion proteins are secreted from the cells and self-assembled into nanoparticles. The nanoparticles can be purified using known techniques, for example by a few different chromatography procedures, e.g. Mono Q (anion exchange) followed by size exclusion (SUPEROSE® 6) chromatography.

Several embodiments include a monomeric subunit of a ferritin, encapsulin, SOR, or lumazine synthase protein, or any portion thereof which is capable of directing self-assembly of monomeric subunits into the globular form of the protein. Amino acid sequences from monomeric subunits of any known ferritin, encapsulin, SOR, or lumazine synthase protein can be used to produce fusion proteins with the disclosed recombinant HIV-1 Env ectodomain or immunogenic fragment thereof, so long as the monomeric subunit is capable of self-assembling into a nanoparticle displaying recombinant HIV-1 Env ectodomain or immunogenic fragment thereof on its surface.

The fusion proteins need not comprise the full-length sequence of a monomeric subunit polypeptide of a ferritin, encapsulin, SOR, or lumazine synthase protein. Portions, or regions, of the monomeric subunit polypeptide can be utilized so long as the portion comprises amino acid sequences that direct self-assembly of monomeric subunits into the globular form of the protein.

In some embodiments, it may be useful to engineer mutations into the amino acid sequence of the monomeric ferritin, encapsulin, SOR, or lumazine synthase subunits. For example, it may be useful to alter sites such as enzyme recognition sites or glycosylation sites in order to give the fusion protein beneficial properties (e.g., half-life).

It will be understood by those skilled in the art that fusion of any of the disclosed recombinant HIV-1 Env proteins stabilized in a prefusion mature closed conformation or immunogenic fragments thereof to the ferritin, encapsulin, SOR, or lumazine synthase protein should be done such that the disclosed recombinant HIV-1 Env proteins stabilized in a prefusion mature closed conformation or immunogenic fragments thereof does not interfere with self-assembly of the monomeric ferritin, encapsulin, SOR, or lumazine synthase subunits into the globular protein, and that the ferritin, encapsulin, SOR, or lumazine synthase subunits do not interfere with the ability of the disclosed recombinant HIV-1 Env proteins stabilized in a prefusion mature closed conformation or immunogenic fragments thereof to elicit an immune response to HIV. In some embodiments, the ferritin, encapsulin, SOR, or lumazine synthase protein and disclosed recombinant HIV-1 Env proteins stabilized in a prefusion mature closed conformation or immunogenic fragments thereof can be joined together directly without affecting the activity of either portion. In other embodiments, the ferritin, encapsulin, SOR, or lumazine synthase protein and the disclosed recombinant HIV-1 Env proteins stabilized in a prefusion mature closed conformation or immunogenic fragments thereof can be joined using a linker (also referred to as a spacer) sequence. The linker sequence is designed to position the ferritin, encapsulin, SOR, or lumazine synthase portion of the fusion protein and the recombinant HIV-1 Env ectodomain stabilized in a prefusion mature closed conformation or immunogenic fragments thereof can be linked to an portion of the fusion protein, with regard to one another, such that the fusion protein maintains the ability to assemble into nanoparticles, and also elicit an immune response to HIV. In several embodiments, the linker sequences comprise amino acids. Preferable amino acids to use are those having small side chains and/or those which are not charged. Such amino acids are less likely to interfere with proper folding and activity of the fusion protein. Accordingly, preferred amino acids to use in linker sequences, either alone or in combination are serine, glycine and alanine. One example of such a linker sequence is SGG. Amino acids can be added or subtracted as needed. Those skilled in the art are capable of determining appropriate linker sequences for construction of protein nanoparticles.

The disclosed recombinant HIV-1 Env proteins stabilized in a prefusion mature closed conformation or immunogenic fragments thereof can be linked to ferritin, encapsulin, SOR, or lumazine synthase subunits can self-assemble into multi-subunit protein nanoparticles, termed ferritin nanoparticles, encapsulin nanoparticles, SOR nanoparticles, and lumazine synthase nanoparticles, respectively. The nanoparticles including a disclosed recombinant HIV-1 Env ectodomain stabilized in a prefusion mature closed conformation or immunogenic fragment thereof have substantially the same structural characteristics as the native ferritin, encapsulin, SOR, or lumazine synthase nanoparticles that do not include the disclosed recombinant HIV-1 Env ectodomain or immunogenic fragment thereof. That is, they contain 24, 60, 24, or 60 subunits (respectively) and have similar corresponding symmetry.

Additional sequences of recombinant HIV-1 Env proteins as disclosed herein linked to a protein nanoparticle subunit are provided as SEQ ID NOs: 478-507.

In some embodiments, the recombinant HIV-1 Env ectodomain stabilized in a prefusion mature closed conformation or immunogenic fragment thereof can be linked to *Escherichia coli* enzyme 2-hydroxypentadienoic acid hydratase subunit (see Montgomery et al., J. Mol. Biol. 396: 1379-1391, 2010), which can include, for example, the amino acid sequence set forth as SEQ ID NO: 2101 or a fragment thereof. In some embodiments, a disclosed recombinant HIV-1 Env ectodomain stabilized in a prefusion mature closed conformation or immunogenic fragment thereof can be linked to a cocksfoot mottle virus coat protein subunit (see Tars et al., Virology 310: 287-297, 2003), which can include, for example, the amino acid sequence set forth as SEQ ID NO: 2102 or a fragment thereof. In some embodiments, a disclosed recombinant HIV-1 Env ectodomain stabilized in a prefusion mature closed conformation or immunogenic fragment thereof can be linked to a Rice yellow mottle virus capsid protein subunit (see Qu et al., Structure Fold. Des. 8: 1095-1103, 2000), which can include, for example, the amino acid sequence set forth as SEQ ID NO: 2103 or a fragment thereof. In some embodiments, a disclosed recombinant HIV-1 Env ectodomain stabilized in a prefusion mature closed conformation or immunogenic fragment thereof can be linked to a *sesbania* mosaic virus coat protein subunit (see Bhuvaneshwari et al., Structure 3: 1021-1030, 1995), which can include, for example, the amino acid sequence set forth as SEQ ID NO: 2104 or a fragment thereof. In some embodiments, a disclosed recombinant HIV-1 Env ectodomain stabilized in a prefusion mature closed conformation or immunogenic fragment thereof can be linked to a tomato bushy stunt virus coat protein subunit (see Hopper et al., J. Mol. Biol. 177: 701-713, 1984), which can include, for example, the amino acid sequence set forth as SEQ ID NO: 2105 or a fragment thereof. In some embodiments, a disclosed recombinant HIV-1 Env ectodomain stabilized in a prefusion mature closed conformation or immunogenic fragment thereof can be linked to a phage MS2 protein capsid subunit (see van den Worm et al., Nucleic Acids Res. 26: 1345-1351, 1998), which can include, for example, the amino acid sequence set forth as SEQ ID NO: 2106 or a fragment thereof. In some embodiments, a disclosed recombinant HIV-1 Env ectodomain stabilized in a prefusion mature closed conformation or immunogenic fragment thereof can be linked to bacteriophage fr capsid subunit (see Liljas et al., J. Mol. Biol. 244: 279-290, 1994), which can include, for example, the amino acid sequence set forth as SEQ ID NO: 2107 or a fragment thereof. In some embodiments, a disclosed recombinant HIV-1 Env ectodomain stabilized in a prefusion mature closed conformation or immunogenic fragment thereof can be linked to a bacteriophage phiCb5 coat protein subunit (see Plevka et al. J. Mol. Biol. 391: 635-647, 2009), which can include, for example, the amino acid sequence set forth as SEQ ID NO: 2108 or a fragment thereof. In some embodiments, a disclosed recombinant HIV-1 Env ectodomain stabilized in a prefusion mature closed conformation or immunogenic fragment thereof can be linked to a HK97 bacteriophage capsid subunit (see Helgstrand et al., J. Mol. Biol. 334: 885, 2003), which can include, for example, the amino acid sequence set forth as SEQ ID NO: 2109 or a fragment thereof. In some embodiments, a disclosed recombinant HIV-1 Env ectodomain stabilized in a prefusion mature closed conformation or immunogenic fragment thereof can be linked to a bacteriophage GA protein capsid subunit (see Tars et al., J. Mol. Biol. 271: 759-773, 1997), which can include, for example, the amino acid sequence set forth as SEQ ID NO: 2110 or a fragment thereof. In some embodiments, a disclosed recombinant HIV-1 Env ectodomain stabilized in a prefusion mature closed conformation or immunogenic fragment thereof can be linked to a bacteriophage PRR1 coat protein subunit (see Persson et al., J. Mol. Biol. 383: 914, 2008), which can include, for example, the amino acid sequence set forth as SEQ ID NO: 2111 or a fragment thereof. In some embodiments, a disclosed recombinant HIV-1 Env ectodomain stabilized in a prefusion mature closed conformation or immunogenic fragment thereof can be linked to a bacteriophage PP7 coat protein subunit (see Tars et al., Acta Crystallogr., Sect. D 56: 398, 2000), which can include, for example, the amino acid sequence set forth as SEQ ID NO: 2112 or a fragment thereof. In some embodiments, a disclosed recombinant HIV-1 Env ectodomain stabilized in a prefusion mature closed conformation or immunogenic fragment thereof can be linked to a bacteriophage Q beta capsid subunit (see Golmohammadi et al., Structure 4: 543-554, 1996), which can include, for example, the amino acid sequence set forth as SEQ ID NO: 2113 or a fragment thereof.

E. Polynucleotides and Expression Polynucleotides encoding a disclosed immunogen (e.g., a HIV-1 Env ectodomain stabilized in a prefusion mature closed conformation, or an immunogenic fragment thereof), or protein nanoparticles (or a subunit thereof) or vectors, disclosed herein are also provided. These polynucleotides include DNA, cDNA and RNA sequences which encode the antigen. One of skill in the art can readily use the genetic code to construct a variety of functionally equivalent nucleic acids, such as nucleic acids which differ in sequence but which encode the same antibody sequence, or encode a conjugate or fusion protein including the nucleic acid sequence.

In a non-limiting example, a polynucleotide sequence set forth as SEQ ID NO: 757, which encodes the single chain HIV-1 Env set forth as SEQ ID NO: 352. In another example, a polynucleotide sequence set forth as SEQ ID NO: 2119, which encodes the BG505.SOSIP.R6.664.T332N_I201C/A433C HIV-1 Env set forth as SEQ ID NO: 26. For reference, native BG505 DNA sequence is provided as SEQ ID NO: 2120.

In several embodiments, the nucleic acid molecule encodes a precursor of a disclosed recombinant HIV-1 Env ectodomain or immunogenic fragment thereof, that, when expressed in an appropriate cell, is processed into a disclosed recombinant HIV-1 Env ectodomain or immunogenic fragment thereof. For example, the nucleic acid molecule can encode a recombinant HIV-1 Env ectodomain including a N-terminal signal sequence for entry into the cellular secretory system that is proteolytically cleaved in the during processing of the HIV-1 Env protein in the cell. In some embodiments, the signal peptide includes the amino acid sequence set forth as residues 1-30 of SEQ ID NO: 2.

Exemplary nucleic acids can be prepared by cloning techniques. Examples of appropriate cloning and sequencing techniques, and instructions sufficient to direct persons of skill through many cloning exercises are known (see, e.g., Sambrook et al. (Molecular Cloning: A Laboratory Manual, 4$^{th}$ ed, Cold Spring Harbor, N.Y., 2012) and Ausubel et al. (In Current Protocols in Molecular Biology, John Wiley & Sons, New York, through supplement 104, 2013). Product information from manufacturers of biological reagents and experimental equipment also provide useful information. Such manufacturers include the SIGMA Chemical Company (Saint Louis, Mo.), R&D Systems (Minneapolis, Minn.), Pharmacia Amersham (Piscataway, N.J.), CLONTECH Laboratories, Inc. (Palo Alto, Calif.), Chem Genes Corp., Aldrich Chemical Company (Milwaukee, Wis.), Glen Research, Inc., GIBCO BRL Life Technologies, Inc. (Gaithersburg, Md.), Fluka Chemica-Biochemika Analytika (Fluka Chemie AG, Buchs, Switzerland), Invitrogen (Carlsbad, Calif.), and Applied Biosystems (Foster City, Calif.), as well as many other commercial sources known to one of skill.

Nucleic acids can also be prepared by amplification methods. Amplification methods include polymerase chain reaction (PCR), the ligase chain reaction (LCR), the transcription-based amplification system (TAS), the self-sustained sequence replication system (3SR). A wide variety of cloning methods, host cells, and in vitro amplification methodologies are well known to persons of skill.

The polynucleotides encoding a recombinant HIV-1 Env proteins stabilized in a prefusion mature closed conformation, fragments thereof, and protein nanoparticles (or a subunit thereof) can include a recombinant DNA which is incorporated into a vector into an autonomously replicating plasmid or virus or into the genomic DNA of a prokaryote or eukaryote, or which exists as a separate molecule (such as a cDNA) independent of other sequences. The nucleotides can be ribonucleotides, deoxyribonucleotides, or modified forms of either nucleotide. The term includes single and double forms of DNA.

Polynucleotide sequences encoding recombinant HIV-1 Env proteins stabilized in a prefusion mature closed conformation, fragments thereof, and protein nanoparticles (or a subunit thereof) can be operatively linked to expression control sequences. An expression control sequence operatively linked to a coding sequence is ligated such that expression of the coding sequence is achieved under conditions compatible with the expression control sequences. The expression control sequences include, but are not limited to, appropriate promoters, enhancers, transcription terminators, a start codon (i.e., ATG) in front of a protein-encoding gene, splicing signal for introns, maintenance of the correct reading frame of that gene to permit proper translation of mRNA, and stop codons.

DNA sequences encoding the recombinant HIV-1 Env proteins stabilized in a prefusion mature closed conformation, fragments thereof, and protein nanoparticles (or a subunit thereof) can be expressed in vitro by DNA transfer into a suitable host cell. The cell may be prokaryotic or eukaryotic. The term also includes any progeny of the subject host cell. It is understood that all progeny may not be identical to the parental cell since there may be mutations that occur during replication. Methods of stable transfer, meaning that the foreign DNA is continuously maintained in the host, are known in the art.

Hosts can include microbial, yeast, insect and mammalian organisms. Methods of expressing DNA sequences having eukaryotic or viral sequences in prokaryotes are well known in the art. Non-limiting examples of suitable host cells include bacteria, archea, insect, fungi (for example, yeast), plant, and animal cells (for example, mammalian cells, such as human). Exemplary cells of use include *Escherichia coli, Bacillus subtilis, Saccharomyces cerevisiae, Salmonella typhimurium*, SF9 cells, C129 cells, 293 cells, *Neurospora*, and immortalized mammalian myeloid and lymphoid cell lines. Techniques for the propagation of mammalian cells in culture are well-known (see, e.g., Helgason and Miller (Eds.), 2012, Basic Cell Culture Protocols (Methods in Molecular Biology), 4$^{th}$ Ed., Humana Press). Examples of commonly used mammalian host cell lines are VERO and HeLa cells, CHO cells, and WI38, BHK, and COS cell lines, although cell lines may be used, such as cells designed to provide higher expression, desirable glycosylation patterns, or other features. In some embodiments, the host cells include HEK293 cells or derivatives thereof, such as GnTI$^{-/-}$ cells (ATCC® No. CRL-3022), or HEK-293F cells.

Transformation of a host cell with recombinant DNA can be carried out by conventional techniques as are well known to those skilled in the art. Where the host is prokaryotic, such as, but not limited to, *E. coli*, competent cells which are capable of DNA uptake can be prepared from cells harvested after exponential growth phase and subsequently treated by the CaCl$_2$ method using procedures well known in the art. Alternatively, MgCl$_2$ or RbCl can be used. Transformation can also be performed after forming a protoplast of the host cell if desired, or by electroporation.

When the host is a eukaryote, such methods of transfection of DNA as calcium phosphate coprecipitates, conventional mechanical procedures such as microinjection, electroporation, insertion of a plasmid encased in liposomes, or viral vectors can be used. Eukaryotic cells can also be co-transformed with polynucleotide sequences encoding a disclosed antigen, and a second foreign DNA molecule encoding a selectable phenotype, such as the herpes simplex thymidine kinase gene. Another method is to use a eukaryotic viral vector, such as simian virus 40 (SV40) or bovine papilloma virus, to transiently infect or transform eukaryotic cells and express the protein (see for example, Viral Expression Vectors, Springer press, Muzyczka ed., 2011). One of skill in the art can readily use an expression systems such as plasmids and vectors of use in producing proteins in cells including higher eukaryotic cells such as the COS, CHO, HeLa and myeloma cell lines.

In one non-limiting example, a disclosed immunogen is expressed using the pVRC8400 vector (described in Barouch et al., J. Virol, 79, 8828-8834, 2005, which is incorporated by reference herein).

Modifications can be made to a nucleic acid encoding a recombinant HIV-1 Env ectodomain stabilized in a prefusion mature closed conformation, fragment thereof, and protein nanoparticle (or a subunit thereof) described herein without diminishing its biological activity. Some modifications can be made to facilitate the cloning, expression, or incorporation of the targeting molecule into a fusion protein. Such modifications are well known to those of skill in the art and include, for example, termination codons, a methionine added at the amino terminus to provide an initiation, site, additional amino acids placed on either terminus to create conveniently located restriction sites, or additional amino acids (such as poly His) to aid in purification steps.

In addition to recombinant methods, the recombinant HIV-1 Env proteins stabilized in a prefusion mature closed conformation, fragments thereof, and protein nanoparticles (or a subunit thereof) can also be constructed in whole or in part using protein synthesis methods known in the art.

F. Virus-Like Particles

In some embodiments, a virus-like particle (VLP) is provided that includes a disclosed immunogen (e.g., a recombinant HIV-1 Env ectodomain or immunogenic fragment thereof). VLPs lack the viral components that are required for virus replication and thus represent a highly attenuated form of a virus. The VLP can display a polypeptide (e.g., a recombinant HIV-1 Env protein) that is capable of eliciting an immune response to HIV when administered to a subject. Virus like particles and methods of their production are known and familiar to the person of ordinary skill in the art, and viral proteins from several viruses are known to form VLPs, including human papillomavirus, HIV (Kang et al., Biol. Chem. 380: 353-64 (1999)), Semliki-Forest virus (Notka et al., Biol. Chem. 380: 341-52 (1999)), human polyomavirus (Goldmann et al., J. Virol. 73: 4465-9 (1999)), rotavirus (Jiang et al., Vaccine 17: 1005-13 (1999)), parvovirus (Casal, Biotechnology and Applied Biochemistry, Vol 29, Part 2, pp 141-150 (1999)), canine parvovirus (Hurtado et al., J. Virol. 70: 5422-9 (1996)), hepatitis E virus (Li et al., J. Virol. 71: 7207-13 (1997)), and Newcastle disease virus. The formation of such VLPs can be detected by any suitable technique. Examples of suitable techniques known in the art for detection of VLPs in a medium include, e.g., electron microscopy techniques, dynamic light scattering (DLS), selective chromatographic separation (e.g., ion exchange, hydrophobic interaction, and/or size exclusion chromatographic separation of the VLPs) and density gradient centrifugation.

The virus like particle can include any of the recombinant HIV-1 Env ectodomain trimers or immunogenic fragments thereof, that are disclosed herein. For example, the virus like particle can include the recombinant HIV-1 Env ectodomain trimer or immunogenic fragments thereof, of any of claims X-Y included in the claim set below. Embodiments concerning the virus-like particles are further described in Clauses 1-16, below.

Clause 1. A virus like particle comprising the recombinant HIV-1 Env ectodomain trimer or immunogenic fragment thereof of any one of claims 1-67;

particularly wherein the recombinant HIV-1 Env ectodomain trimer or immunogenic fragment thereof is linked to a transmembrane domain;

particularly wherein the recombinant HIV-1 Env ectodomain trimer comprises DS and SOS substitutions as described herein;

particularly wherein the recombinant HIV-1 Env ectodomain trimer is a chimeric HIV-1 Env trimer comprising a BG505 "platform" as described herein, a V1V2 domain from a CAP256.SU (SEQ ID NO: 51), a BB201.B42 (SEQ ID NO: 81), a KER2018.11 (SEQ ID NO: 107), a CH070.1 (SEQ ID NO: 174), a ZM233.6 (SEQ ID NO: 745), a Q23.17 (SEQ ID NO: 746), a A244 (SEQ ID NO: 747), a T250-4 (SEQ ID NO: 2114), or a WITO.33 (SEQ ID NO: 748) strain of HIV-1, with the remainder of the HIV-1 Env ectodomain based on Env from a 45_01dG5 Env or a 426c Env that further comprises amino acid substitutions to remove the N-linked glycan sequons at positions 276, 460, 463.

Clause 2. An isolated nucleic acid molecule encoding the virus like particle of clause 1.

Clause 3. The nucleic acid molecule of clause 2, wherein the nucleic acid molecule encodes a precursor protein of the gp120/gp41 protomers in the recombinant HIV-1 Env ectodomain trimer.

Clause 4. The nucleic acid molecule of clause 2 or clause 3, operably linked to a promoter.

Clause 5. A vector comprising the nucleic acid molecule of clause 4.

Clause 6. An isolated host cell comprising the vector of clause 5.

Clause 7. The virus-like particle of any one of the prior clauses, wherein administration of an effective amount of the virus like particle induces a neutralizing immune response to HIV-1 Env in the subject.

Clause 8. An immunogenic composition comprising an effective amount of the virus like particle of any one of the prior clauses, and a pharmaceutically acceptable carrier.

Clause 9. The immunogenic composition of clause 8, further comprising an adjuvant.

Clause 10. A method for generating an immune response to Human Immunodeficiency Virus type 1 (HIV-1) gp120 in a subject, comprising administering to the subject an effective amount of the immunogenic composition of clause 9 or clause 10, thereby generating the immune response.

Clause 11. A method for treating or preventing a Human Immunodeficiency Virus type 1 (HIV-1) infection in a subject, comprising administering to the subject a therapeutically effective amount of the immunogenic composition of clause 9 or clause 10, thereby treating the subject or preventing HIV-1 infection of the subject.

Clause 12. The method of clause 10 clause 11, comprising a prime-boost administration of the immunogenic composition.

Clause 13. The method of any of clauses 10-12, wherein the subject is at risk of or has an HIV-1 infection.

Clause 14. A kit comprising the virus like particle, nucleic acid molecule, vector, or composition, of any of clauses 1-9, and instructions for using the kit.

Clause 15. Use of the virus like particle, nucleic acid molecule, vector, or composition of any of clauses 1-9, to inhibit or prevent HIV-1 infection in a subject.

Clause 16. Use of the virus like particle, nucleic acid molecule, vector, or composition of any of clauses 1-9, to induce an immune response to HIV-1 Env in a subject.

G. Viral Vectors

The nucleic acid molecules encoding the disclosed immunogens (e.g., a recombinant HIV-1 Env ectodomain stabilized in a prefusion mature closed conformation or an immunogenic fragment thereof) can be included in a viral vector, for example for expression of the antigen in a host cell, or for immunization of a subject as disclosed herein. In some embodiments, the viral vectors are administered to a subject as part of a prime-boost vaccination. In several embodiments, the viral vectors are included in a vaccine, such as a primer vaccine or a booster vaccine for use in a prime-boost vaccination.

In several examples, the viral vector can be replication-competent. For example, the viral vector can have a mutation in the viral genome that does not inhibit viral replication in host cells. The viral vector also can be conditionally replication-competent. In other examples, the viral vector is replication-deficient in host cells.

A number of viral vectors have been constructed, that can be used to express the disclosed antigens, including polyoma, i.e., SV40 (Madzak et al., 1992, *J. Gen. Virol.*, 73:15331536), adenovirus (Berkner, 1992, *Cur. Top. Microbiol. Immunol.*, 158:39-6; Berliner et al., 1988, *Bio Techniques*, 6:616-629; Gorziglia et al., 1992, *J. Virol.*, 66:4407-4412; Quantin et al., 1992, *Proc. Natl. Acad. Sci. USA*, 89:2581-2584; Rosenfeld et al., 1992, *Cell*, 68:143-155; Wilkinson et al., 1992, *Nucl. Acids Res.*, 20:2233-2239; Stratford-Perricaudet et al., 1990, *Hum. Gene Ther.*, 1:241-256), vaccinia virus (Mackett et al., 1992, *Biotechnology*, 24:495-499), adeno-associated virus (Muzyczka, 1992, *Curr. Top. Microbiol. Immunol.*, 158:91-123; On et al., 1990, *Gene*, 89:279-282), herpes viruses including HSV and EBV (Margolskee, 1992, *Curr. Top. Microbiol. Immunol.*, 158:67-90; Johnson et al., 1992, *J. Virol.*, 66:29522965; Fink et al., 1992, *Hum. Gene Ther.* 3:11-19; Breakfield et al., 1987, *Mol. Neurobiol.*, 1:337-371; Fresse et al., 1990, *Biochem. Pharmacol.*, 40:2189-2199), Sindbis viruses (H. Herweijer et al., 1995, *Human Gene Therapy* 6:1161-1167; U.S. Pat. Nos. 5,091,309 and 5,2217,879), alphaviruses (S. Schlesinger, 1993, *Trends Biotechnol.* 11:18-22; I. Frolov et al., 1996, *Proc. Natl. Acad. Sci. USA* 93:11371-11377) and retroviruses of avian (Brandyopadhyay et al., 1984, *Mol. Cell Biol.*, 4:749-754; Petropouplos et al., 1992, *J. Virol.*, 66:3391-3397), murine (Miller, 1992, *Curr. Top. Microbiol. Immunol.*, 158:1-24; Miller et al., 1985, *Mol. Cell Biol.*, 5:431-437; Sorge et al., 1984, *Mol. Cell Biol.*, 4:1730-1737; Mann et al., 1985, *J. Virol.*, 54:401-407), and human origin (Page et al., 1990, *J. Virol.*, 64:5370-5276; Buchschalcher et al., 1992, *J. Virol.*, 66:2731-2739). Baculovirus (*Autographa californica* multinuclear polyhedrosis virus; AcMNPV) vectors are also known in the art, and may be obtained from commercial sources (such as PharMingen, San Diego, Calif.; Protein Sciences Corp., Meriden, Conn.; Stratagene, La Jolla, Calif.).

In several embodiments, the viral vector can include an adenoviral vector that expresses a disclosed recombinant HIV-1 Env ectodomain or immunogenic fragment thereof. Adenovirus from various origins, subtypes, or mixture of subtypes can be used as the source of the viral genome for the adenoviral vector. Non-human adenovirus (e.g., simian, chimpanzee, gorilla, avian, canine, ovine, or bovine adenoviruses) can be used to generate the adenoviral vector. For example, a simian adenovirus can be used as the source of the viral genome of the adenoviral vector. A simian adenovirus can be of serotype 1, 3, 7, 11, 16, 18, 19, 20, 27, 33, 38, 39, 48, 49, 50, or any other simian adenoviral serotype. A simian adenovirus can be referred to by using any suitable abbreviation known in the art, such as, for example, SV, SAdV, SAV or sAV. In some examples, a simian adenoviral vector is a simian adenoviral vector of serotype 3, 7, 11, 16, 18, 19, 20, 27, 33, 38, or 39. In one example, a chimpanzee serotype C Ad3 vector is used (see, e.g., Peruzzi et al., Vaccine, 27:1293-1300, 2009). Human adenovirus can be used as the source of the viral genome for the adenoviral vector. Human adenovirus can be of various subgroups or serotypes. For instance, an adenovirus can be of subgroup A (e.g., serotypes 12, 18, and 31), subgroup B (e.g., serotypes 3, 7, 11, 14, 16, 21, 34, 35, and 50), subgroup C (e.g., serotypes 1, 2, 5, and 6), subgroup D (e.g., serotypes 8, 9, 10, 13, 15, 17, 19, 20, 22, 23, 24, 25, 26, 27, 28, 29, 30, 32, 33, 36-39, and 42-48), subgroup E (e.g., serotype 4), subgroup F (e.g., serotypes 40 and 41), an unclassified serogroup (e.g., serotypes 49 and 51), or any other adenoviral serotype. The person of ordinary skill in the art is familiar with replication competent and deficient adenoviral vectors (including singly and multiply replication deficient adenoviral vectors). Examples of replication-deficient adenoviral vectors, including multiply replication-deficient adenoviral vectors, are disclosed in U.S. Pat. Nos. 5,837,511; 5,851,806; 5,994,106; 6,127,175; 6,482,616; and 7,195,896, and International Patent Application Nos. WO 94/28152, WO 95/02697, WO 95/16772, WO 95/34671, WO 96/22378, WO 97/12986, WO 97/21826, and WO 03/02231 1.

H. Neutralizing Immune Response

A disclosed recombinant HIV-1 Env ectodomain stabilized in a prefusion mature closed conformation, or immunogenic fragment thereof, can be used to elicit a neutralizing immune response to HIV-1 in a subject. In several such embodiments, induction of the immune response includes production of neutralizing antibodies to HIV-1.

In several embodiments, following immunization of a subject with a disclosed immunogen (e.g., as described herein) serum can be collected from the subject at appropriate time points, frozen, and stored for neutralization testing. Methods to assay for neutralization activity are known to the person of ordinary skill in the art and are further described herein, and include, but are not limited to, plaque reduction neutralization (PRNT) assays, microneutralization assays, flow cytometry based assays, single-cycle infection assays (e.g., as described in Martin et al. (2003) *Nature Biotechnology* 21:71-76), and pseudovirus neutralization assays (e.g., as described in Georgiev et al. (Science, 340, 751-756, 2013), Seaman et al. (J. Virol., 84, 1439-1452, 2005), and Mascola et al. (J. Virol., 79, 10103-10107, 2005), each of which is incorporated by reference herein in its entirety.

In some embodiments, the serum neutralization activity can be assayed using a panel of HIV-1 pseudoviruses as described in Georgiev et al., Science, 340, 751-756, 2013 or Seaman et al. J. Virol., 84, 1439-1452, 2005. Briefly, pseudovirus stocks are prepared by co-transfection of 293T cells with an HIV-1 Env-deficient backbone and an expression plasmid encoding the Env gene of interest. The serum to be assayed is diluted in Dulbecco's modified Eagle medium-10% FCS (Gibco) and mixed with pseudovirus. After 30 min, 10,000 TZM-bl cells are added, and the plates are incubated for 48 hours. Assays are developed with a luciferase assay system (Promega, Madison, Wis.), and the relative light units (RLU) are read on a luminometer (Perkin-Elmer, Waltham, Mass.). To account for background, a cutoff of $ID_{50} \geq 40$ can be used as a criterion for the presence of serum neutralization activity against a given pseudovirus.

In some embodiments, administration of a therapeutically effective amount of one or more of the disclosed immunogens to a subject (e.g., by a prime-boost administration of a DNA vector encoding a disclosed immunogen (prime) followed by a protein nanoparticle including a disclosed immunogen (boost)) induces a neutralizing immune response in the subject. In several embodiments, the neutralizing immune response can be detected using a pseudovirus neutralization assay against a panel of HIV-1 pseudoviruses including HIV-1 Env proteins from different HIV-1 strains. In one example, the panel can include pseudoviruses including Env proteins from HIV-1 strains from Clade A (KER2018.11, Q23.17, Q168.a2, Q769.h5, and RW020.2), Clade B (BaL.01, 6101.10, BG1168.01, CAAN.A2, JR-FL, JR-CSF.JB, PVO.4, THRO4156.18, TRJO4551.58, TRO.11, and YU2), and Clade C (DU156.12, DU422.01, ZA012.29, ZM55.28a, and ZM106.9). In other examples, the panel can include pseudoviruses including Env proteins from the HIV-1 strains listed in Table S5 or Table S6 of Georgiev et al. (Science, 340, 751-756, 2013, which is incorporated by reference herein in its entirety), or Table 1 of Seaman et al. (J. Virol., 84, 1439-1452, 2005, which is incorporated by reference herein in its entirety).

In some embodiments, administration of a therapeutically effective amount of one or more of the disclosed immunogen to a subject (e.g., by a prime-boost administration of a DNA vector encoding a disclosed immunogen (prime) followed by a protein nanoparticle including a disclosed immunogen (boost)) induces a neutralizing immune response in the subject, wherein serum from the subject neutralizes, with an $ID_{50} \geq 40$, at least 30% (such as at least 40%, at least 50%, at least 60%, at least 70%, at least 80%, or at least 90%) of pseudoviruses is a panel of pseudoviruses including the HIV-1 Env proteins listed in Table S5 or Table S6 of Georgiev et al. (Science, 340, 751-756, 2013), or Table 1 of Seaman et al. (J. Virol., 84, 1439-1452, 2005) or including Env proteins from HIV-1 strains from Clade A (KER2018.11, Q23.17, Q168.a2, Q769.h5, and RW020.2), Clade B (BaL.01, 6101.10, BG1168.01, CAAN.A2, JR-FL, JR-CSF.JB, PVO.4, THRO4156.18, TRJO4551.58, TRO.11, and YU2), and Clade C (DU156.12, DU422.01, ZA012.29, ZM55.28a, and ZM106.9).

In additional embodiments, administration of a therapeutically effective amount of one or more of the disclosed immunogen to a subject (e.g., by a prime-boost administration of a DNA vector encoding a disclosed immunogen (prime) followed by a protein nanoparticle including a disclosed immunogen (boost)) induces a neutralizing immune response in the subject, wherein serum from the subject neutralizes, with an $ID_{50} \geq 40$, at least 30% (such as at least 40%, at least 50%, at least 60%, at least 70%, at least 80%, or at least 90%) of pseudoviruses is a panel of pseudoviruses including the Clade A, Clade B, or Clade C HIV-1 Env proteins listed in Table S5 or Table S6 of Georgiev et al. (Science, 340, 751-756, 2013), or Table 1 of Seaman et al. (J. Virol., 84, 1439-1452, 2005) or including Env proteins from HIV-1 strains from Clade A (KER2018.11, Q23.17, Q168.a2, Q769.h5, and RW020.2), Clade B (BaL.01, 6101.10, BG1168.01, CAAN.A2, JR-FL, JR-CSF.JB, PVO.4, THR04156.18, TRJ04551.58, TRO.11, and YU2), and Clade C (DU156.12, DU422.01, ZA012.29, ZM55.28a, and ZM106.9).

I. Compositions

The disclosed immunogens (for example, a recombinant HIV-1 Env ectodomain or immunogenic fragment thereof, or a protein nanoparticle including such proteins), or nucleic acid molecule encoding an immunogen, can be included in a pharmaceutical composition (including therapeutic and prophylactic formulations), often combined together with one or more pharmaceutically acceptable vehicles and, optionally, other therapeutic ingredients (for example, antibiotics or antiviral drugs). In several embodiments, pharmaceutical compositions including one or more of the disclosed immunogens are immunogenic compositions.

Such pharmaceutical compositions can be administered to subjects by a variety of administration modes known to the person of ordinary skill in the art, for example, intramuscular, subcutaneous, intravenous, intra-arterial, intra-articular, intraperitoneal, or parenteral routes.

To formulate the pharmaceutical compositions, the disclosed immunogens (for example, a recombinant HIV-1 Env ectodomain or immunogenic fragment thereof, or a protein nanoparticle including such proteins), or nucleic acid molecule encoding an immunogen, can be combined with various pharmaceutically acceptable additives, as well as a base or vehicle for dispersion of the conjugate. Desired additives include, but are not limited to, pH control agents, such as arginine, sodium hydroxide, glycine, hydrochloric acid, citric acid, and the like. In addition, local anesthetics (for example, benzyl alcohol), isotonizing agents (for example, sodium chloride, mannitol, sorbitol), adsorption inhibitors (for example, TWEEN® 80), solubility enhancing agents (for example, cyclodextrins and derivatives thereof), stabilizers (for example, serum albumin), and reducing agents (for example, glutathione) can be included. Adjuvants, such as aluminum hydroxide (ALHYDROGEL®, available from Brenntag Biosector, Copenhagen, Denmark and AMPHOGEL®, Wyeth Laboratories, Madison, N.J.), Freund's adjuvant, MPL™ (3-O-deacylated monophosphoryl lipid A; Corixa, Hamilton, Ind.) and IL-12 (Genetics Institute, Cambridge, Mass.), among many other suitable adjuvants well known in the art, can be included in the compositions.

When the composition is a liquid, the tonicity of the formulation, as measured with reference to the tonicity of 0.9% (w/v) physiological saline solution taken as unity, is typically adjusted to a value at which no substantial, irreversible tissue damage will be induced at the site of administration. Generally, the tonicity of the solution is adjusted to a value of about 0.3 to about 3.0, such as about 0.5 to about 2.0, or about 0.8 to about 1.7.

The disclosed immunogens (for example, a recombinant HIV-1 Env ectodomain or immunogenic fragment thereof, or a protein nanoparticle including such proteins), or nucleic acid molecule encoding an immunogen can be dispersed in a base or vehicle, which can include a hydrophilic compound having a capacity to disperse the antigens, and any desired additives. The base can be selected from a wide range of suitable compounds, including but not limited to, copolymers of polycarboxylic acids or salts thereof, carboxylic anhydrides (for example, maleic anhydride) with other monomers (for example, methyl (meth)acrylate, acrylic acid and the like), hydrophilic vinyl polymers, such as polyvinyl acetate, polyvinyl alcohol, polyvinylpyrrolidone, cellulose derivatives, such as hydroxymethylcellulose, hydroxypropylcellulose and the like, and natural polymers, such as chitosan, collagen, sodium alginate, gelatin, hyaluronic acid, and nontoxic metal salts thereof. Often, a biodegradable polymer is selected as a base or vehicle, for example, polylactic acid, poly(lactic acid-glycolic acid) copolymer, polyhydroxybutyric acid, poly(hydroxybutyric acid-glycolic acid) copolymer and mixtures thereof. Alternatively or additionally, synthetic fatty acid esters such as polyglycerin fatty acid esters, sucrose fatty acid esters and the like can be employed as vehicles. Hydrophilic polymers and other vehicles can be used alone or in combination, and enhanced structural integrity can be imparted to the vehicle by partial crystallization, ionic bonding, cross-linking and the like. The vehicle can be provided in a variety of forms, including fluid or viscous solutions, gels, pastes, powders, microspheres and films, for examples for direct application to a mucosal surface.

The disclosed immunogens (for example, a recombinant HIV-1 Env ectodomain or immunogenic fragment thereof, or a protein nanoparticle including such proteins), or nucleic acid molecule encoding an immunogen can be combined with the base or vehicle according to a variety of methods, and release of the antigens can be by diffusion, disintegration of the vehicle, or associated formation of water channels. In some circumstances, the disclosed immunogens (for example, a recombinant HIV-1 Env ectodomain or immunogenic fragment thereof, or a protein nanoparticle including such proteins), or nucleic acid molecule encoding an immunogen is dispersed in microcapsules (microspheres) or nanocapsules (nanospheres) prepared from a suitable polymer, for example, isobutyl 2-cyanoacrylate (see, for example, Michael et al., *J. Pharmacy Pharmacol.* 43:1-5, 1991), and dispersed in a biocompatible dispersing medium, which yields sustained delivery and biological activity over a protracted time.

The pharmaceutical compositions of the disclosure can alternatively contain as pharmaceutically acceptable vehicles substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, and triethanolamine oleate. For solid compositions, conventional nontoxic pharmaceutically acceptable vehicles can be used which include, for example, pharmaceutical grades of mannitol, lactose, starch, magnesium stearate, sodium saccharin, talcum, cellulose, glucose, sucrose, magnesium carbonate, and the like.

Pharmaceutical compositions for administering the immunogenic compositions can also be formulated as a solution, microemulsion, or other ordered structure suitable for high concentration of active ingredients. The vehicle can be a solvent or dispersion medium containing, for example, water, ethanol, polyol (for example, glycerol, propylene glycol, liquid polyethylene glycol, and the like), and suitable mixtures thereof. Proper fluidity for solutions can be maintained, for example, by the use of a coating such as lecithin, by the maintenance of a desired particle size in the case of dispersible formulations, and by the use of surfactants. In many cases, it will be desirable to include isotonic agents, for example, sugars, polyalcohols, such as mannitol and sorbitol, or sodium chloride in the composition. Prolonged absorption of the disclosed antigens can be brought about by including in the composition an agent which delays absorption, for example, monostearate salts and gelatin.

In certain embodiments, the disclosed immunogens (for example, a recombinant HIV-1 Env ectodomain or immunogenic fragment thereof, or a protein nanoparticle including such proteins), or nucleic acid molecule encoding an immunogen can be administered in a time-release formulation, for example in a composition that includes a slow release polymer. These compositions can be prepared with vehicles that will protect against rapid release, for example a controlled release vehicle such as a polymer, microencapsulated delivery system or bioadhesive gel. Prolonged delivery in various compositions of the disclosure can be brought about by including in the composition agents that delay absorption, for example, aluminum monostearate hydrogels and gelatin. When controlled release formulations are desired, controlled release binders suitable for use in accordance with the disclosure include any biocompatible controlled release material which is inert to the active agent and which is capable of incorporating the disclosed antigen and/or other biologically active agent. Numerous such materials are known in the art. Useful controlled-release binders are materials that are metabolized slowly under physiological conditions following their delivery (for example, at a mucosal surface, or in the presence of bodily fluids). Appropriate binders include, but are not limited to, biocompatible polymers and copolymers well known in the art for use in sustained release formulations. Such biocompatible compounds are non-toxic and inert to surrounding tissues, and do not trigger significant adverse side effects, such as nasal irritation, immune response, inflammation, or the like. They are metabolized into metabolic products that are also biocompatible and easily eliminated from the body. Numerous systems for controlled delivery of therapeutic proteins are known (e.g., U.S. Pat. Nos. 5,055,303; 5,188,837; 4,235,871; 4,501,728; 4,837,028; 4,957,735; and 5,019,369; 5,055,303; 5,514,670; 5,413,797; 5,268,164; 5,004,697; 4,902,505; 5,506,206; 5,271,961; 5,254,342; and 5,534,496).

Exemplary polymeric materials for use in the present disclosure include, but are not limited to, polymeric matrices derived from copolymeric and homopolymeric polyesters having hydrolyzable ester linkages. A number of these are known in the art to be biodegradable and to lead to degradation products having no or low toxicity. Exemplary polymers include polyglycolic acids and polylactic acids, poly (DL-lactic acid-co-glycolic acid), poly(D-lactic acid-co-glycolic acid), and poly(L-lactic acid-co-glycolic acid). Other useful biodegradable or bioerodable polymers include, but are not limited to, such polymers as poly (epsilon-caprolactone), poly(epsilon-aprolactone-CO-lactic acid), poly(epsilon.-aprolactone-CO-glycolic acid), poly (beta-hydroxy butyric acid), poly(alkyl-2-cyanoacrilate), hydrogels, such as poly(hydroxyethyl methacrylate), polyamides, poly(amino acids) (for example, L-leucine, glutamic acid, L-aspartic acid and the like), poly(ester urea), poly(2-hydroxyethyl DL-aspartamide), polyacetal polymers, polyorthoesters, polycarbonate, polymaleamides, polysaccharides, and copolymers thereof. Many methods for preparing such formulations are well known to those skilled in the art (see, for example, *Sustained and Controlled Release Drug Delivery Systems*, J. R. Robinson, ed., Marcel Dekker, Inc., New York, 1978). Other useful formulations include controlled-release microcapsules (U.S. Pat. Nos. 4,652,441 and 4,917,893), lactic acid-glycolic acid copolymers useful in making microcapsules and other formulations (U.S. Pat. Nos. 4,677,191 and 4,728,721) and sustained-release compositions for water-soluble peptides (U.S. Pat. No. 4,675,189).

The pharmaceutical compositions of the disclosure typically are sterile and stable under conditions of manufacture, storage and use. Sterile solutions can be prepared by incorporating the conjugate in the required amount in an appropriate solvent with one or a combination of ingredients enumerated herein, as required, followed by filtered sterilization. Generally, dispersions are prepared by incorporating the disclosed antigen and/or other biologically active agent into a sterile vehicle that contains a basic dispersion medium and the required other ingredients from those enumerated herein. In the case of sterile powders, methods of preparation include vacuum drying and freeze-drying which yields a powder of the disclosed antigen plus any additional desired ingredient from a previously sterile-filtered solution thereof. The prevention of the action of microorganisms can be accomplished by various antibacterial and antifungal agents, for example, parabens, chlorobutanol, phenol, sorbic acid, thimerosal, and the like.

Actual methods for preparing administrable compositions will be known or apparent to those skilled in the art and are described in more detail in such publications as *Remingtons Pharmaceutical Sciences*, 19$^{th}$ Ed., Mack Publishing Company, Easton, Pa., 1995.

In several embodiments, the compositions include an adjuvant. The person of ordinary skill in the art is familiar with adjuvants, for example, those that can be included in an immunogenic composition. It will be appreciated that the choice of adjuvant can be different in these different applications, and the optimal adjuvant and concentration for each situation can be determined empirically by those of skill in the art.

The pharmaceutical composition typically contains a therapeutically effective amount of a disclosed immunogen (for example, a recombinant HIV-1 Env ectodomain or immunogenic fragment thereof, or a protein nanoparticle including such proteins), or nucleic acid molecule encoding an immunogen, or viral vector can be prepared by conventional techniques. Preparation of immunogenic compositions, including those for administration to human subjects, is generally described in Pharmaceutical Biotechnology, Vol. 61 Vaccine Design—the subunit and adjuvant approach, edited by Powell and Newman, Plenum Press, 1995. New Trends and Developments in Vaccines, edited by Voller et al., University Park Press, Baltimore, Md., U.S.A. 1978. Encapsulation within liposomes is described, for example, by Fullerton, U.S. Pat. No. 4,235,877. Conjugation of proteins to macromolecules is disclosed, for example, by Likhite, U.S. Pat. No. 4,372,945 and by Armor et al., U.S. Pat. No. 4,474,757. Typically, the amount of antigen in each dose of the immunogenic composition is selected as an amount which induces an immune response without significant, adverse side effects.

The amount of the disclosed immunogen (for example, a recombinant HIV-1 Env ectodomain or immunogenic fragment thereof, or a protein nanoparticle including such proteins), or nucleic acid molecule encoding an immunogen, or viral vector can vary depending upon the specific antigen employed, the route and protocol of administration, and the target population, for example. For protein therapeutics, typically, each human dose will comprise 1-1000 µg of protein, such as from about 1 µg to about 100 µg, for example, from about 1 µg to about 50 µg, such as about 1 µg, about 2 µg, about 5 µg, about 10 µg, about 15 µg, about 20 µg, about 25 µg, about 30 µg, about 40 µg, or about 50 µg. The amount utilized in an immunogenic composition is selected based on the subject population (e.g., infant or elderly). An optimal amount for a particular composition can be ascertained by standard studies involving observation of antibody titers and other responses in subjects. It is understood that a therapeutically effective amount of a disclosed immunogen, such as a recombinant HIV-1 Env ectodomain or fragment thereof, protein nanoparticle, viral vector, or nucleic acid molecule in a immunogenic composition, can include an amount that is ineffective at eliciting an immune response by administration of a single dose, but that is effective upon administration of multiple dosages, for example in a prime-boost administration protocol.

In some embodiments, the composition can be provided as a sterile composition. In more embodiments, the composition can be provided in unit dosage form for use to induce an immune response in a subject, for example, to prevent HIV-1 infection in the subject. A unit dosage form contains a suitable single preselected dosage for administration to a subject, or suitable marked or measured multiples of two or more preselected unit dosages, and/or a metering mechanism for administering the unit dose or multiples thereof. In other embodiments, the composition further includes an adjuvant.

J. Therapeutic Methods

The recombinant HIV-1 Env proteins, immunogenic fragments thereof, protein nanoparticles, polynucleotides encoding the recombinant HIV-1 Env proteins or immunogenic fragments, vectors and compositions, can be used in methods of preventing, inhibiting and treating an HIV-1 infection, as well as methods of inducing an immune response to HIV-1, as described below. In several embodiments, a therapeutically effective amount of an immunogenic composition including one or more of the disclosed recombinant HIV-1 Env proteins or immunogenic fragments thereof, or protein nanoparticles of VLPs, or nucleic acid molecule or viral vector encoding a recombinant HIV-1 Env proteins or immunogenic fragments thereof, can be administered to a subject in order to generate an immune response to HIV-1.

In some embodiments, a subject is selected for treatment that has, or is at risk for developing, an HIV infection, for example because of exposure or the possibility of exposure to HIV. Following administration of a therapeutically effective amount of a recombinant HIV-1 Env proteins, immunogenic fragments thereof, protein nanoparticles, polynucleotides encoding the recombinant HIV-1 Env proteins or immunogenic fragments, vectors and compositions, the subject can be monitored for HIV-1 infection, symptoms associated with HIV-1 infection, or both.

Typical subjects intended for treatment with the therapeutics and methods of the present disclosure include humans, as well as non-human primates and other animals. To identify subjects for prophylaxis or treatment according to the methods of the disclosure, accepted screening methods are employed to determine risk factors associated with a targeted or suspected disease or condition, or to determine the status of an existing disease or condition in a subject. These screening methods include, for example, conventional work-ups to determine environmental, familial, occupational, and other such risk factors that may be associated with the targeted or suspected disease or condition, as well as diagnostic methods, such as various ELISA and other immunoassay methods, which are available and well known in the art to detect and/or characterize HIV infection. These and other routine methods allow the clinician to select patients in need of therapy using the methods and pharmaceutical compositions of the disclosure. In accordance with these methods and principles, a composition can be administered according to the teachings herein, or other conventional methods known to the person of ordinary skill in the art, as an independent prophylaxis or treatment program, or as a follow-up, adjunct or coordinate treatment regimen to other treatments.

The methods can be used to inhibit, treat or prevent HIV infection in vivo. When inhibiting, treating, or preventing infection in vivo, the methods can be used either to avoid infection in an HIV-seronegative subject (e.g., by inducing an immune response that protects against HIV-1 infection), or to treat existing infection in an HIV-seropositive subject. The HIV-seropositive subject may or may not carry a diagnosis of AIDS. Hence in some embodiments the methods involves selecting a subject at risk for contracting HIV infection, or a subject at risk of developing AIDS (such as a subject with HIV infection), and administering a recombinant HIV-1 Env proteins, immunogenic fragments thereof, protein nanoparticles, polynucleotides encoding the recombinant HIV-1 Env proteins or immunogenic fragments, vectors and compositions, to the subject.

Treatment of HIV by inhibiting HIV replication or infection can include delaying the development of AIDS in a subject. Treatment of HIV can also include reducing signs or symptoms associated with the presence of HIV (for example by reducing or inhibiting HIV replication). In some examples, treatment using the methods disclosed herein prolongs the time of survival of the subject.

The administration of a disclosed recombinant HIV-1 Env protein, immunogenic fragment thereof, protein nanoparticle, polynucleotide encoding a recombinant HIV-1 Env ectodomain or immunogenic fragment, vector or composition can be for prophylactic or therapeutic purpose. When provided prophylactically, the disclosed therapeutic agents are provided in advance of any symptom, for example in advance of infection. The prophylactic administration of the disclosed therapeutic agents serves to prevent or ameliorate any subsequent infection. When provided therapeutically, the disclosed therapeutic agents are provided at or after the onset of a symptom of disease or infection, for example after development of a symptom of HIV-1 infection, or after diagnosis of HIV-1 infection. The therapeutic agents can thus be provided prior to the anticipated exposure to HIV virus so as to attenuate the anticipated severity, duration or extent of an infection and/or associated disease symptoms, after exposure or suspected exposure to the virus, or after the actual initiation of an infection.

The immunogenic composition including one or more of the disclosed agents (for example, a recombinant HIV-1 Env protein, immunogenic fragments thereof, protein nanoparticles, or VLP), or nucleic acid molecule or viral vector encoding a recombinant HIV-1 Env ectodomain or immunogenic fragment thereof, can be used in coordinate vaccination protocols or combinatorial formulations. In certain embodiments, novel combinatorial immunogenic compositions and coordinate immunization protocols employ separate immunogens or formulations, each directed toward eliciting an anti-HIV immune response, such as an immune response to HIV-1 Env protein. Separate immunogenic compositions that elicit the anti-HIV immune response can be combined in a polyvalent immunogenic composition administered to a subject in a single immunization step, or they can be administered separately (in monovalent immunogenic compositions) in a coordinate immunization protocol.

HIV infection does not need to be completely eliminated or reduced or prevented for the methods to be effective. For example, treatment with one or more of the disclosed therapeutic agents can reduce or inhibit HIV infection by a desired amount, for example by at least 10%, at least 20%, at least 50%, at least 60%, at least 70%, at least 80%, at least 90%, at least 95%, at least 98%, or even at least 100% (elimination or prevention of detectable HIV infected cells), as compared to HIV infection in the absence of the therapeutic agent. In additional examples, HIV replication can be reduced or inhibited by the disclosed methods. HIV replication does not need to be completely eliminated for the method to be effective. For example, treatment with one or more of the disclosed recombinant HIV-1 Env proteins, immunogenic fragment thereof, protein nanoparticles, polynucleotides encoding a recombinant HIV-1 Env ectodomain or immunogenic fragment, vectors or compositions can HIV replication by a desired amount, for example by at least 10%, at least 20%, at least 50%, at least 60%, at least 70%, at least 80%, at least 90%, at least 95%, at least 98%, or even at least 100% (elimination or prevention of detectable HIV replication), as compared to HIV replication in the absence of the therapeutic agent.

To successfully reproduce itself, HIV must convert its RNA genome to DNA, which is then imported into the host cell's nucleus and inserted into the host genome through the action of HIV integrase. Because HIV's primary cellular target, CD4+ T-Cells, can function as the memory cells of the immune system, integrated HIV can remain dormant for the duration of these cells' lifetime. Memory T-Cells may survive for many years and possibly for decades. This latent HIV reservoir can be measured by co-culturing CD4+ T-Cells from infected patients with CD4+ T-Cells from uninfected donors and measuring HIV protein or RNA (See, e.g., Archin et al., *AIDS,* 22:1131-1135, 2008). In some embodiments, the provided methods of treating or inhibiting HIV infection include reduction or elimination of the latent reservoir of HIV infected cells in a subject. For example, a reduction of at least 10%, at least 20%, at least 50%, at least 60%, at least 70%, at least 80%, at least 90%, at least 95%, at least 98%, or even at least 100% (elimination of detectable HIV) of the latent reservoir of HIV infected cells in a subject, as compared to the latent reservoir of HIV infected cells in a subject in the absence of the treatment with one or more of the provided recombinant HIV-1 Env proteins, immunogenic fragments thereof, protein nanoparticles, polynucleotides encoding a recombinant HIV-1 Env ectodomain or immunogenic fragment, vectors or compositions.

Studies have shown that the rate of HIV transmission from mother to infant is reduced significantly when zidovudine is administered to HIV-infected women during pregnancy and delivery and to the offspring after birth (Connor et al., 1994 *Pediatr Infect Dis J* 14: 536-541). Several studies of mother-to-infant transmission of HIV have demonstrated a correlation between the maternal virus load at delivery and risk of HIV transmission to the child. The disclosed recombinant HIV-1 Env proteins, immunogenic fragments thereof, protein nanoparticles, polynucleotides encoding a recombinant HIV-1 Env ectodomain or immunogenic fragment, vectors and compositions are of use in decreasing HIV-transmission from mother to infant. Thus, in some embodiments a therapeutically effective amount of one or more of the provided therapeutic agents is administered in order to prevent transmission of HIV, or decrease the risk of transmission of HIV, from a mother to an infant. In some embodiments, a therapeutically effective amount of the agent can be administered to a pregnant subject to induce an immune response that generates neutralizing antibodies that are passes to the fetus via the umbilical cord to protect the fetus from infection during birth. In some embodiments, both a therapeutically effective amount of a disclosed recombinant HIV-1 Env protein, immunogenic fragment thereof, protein nanoparticle, polynucleotide encoding a recombinant HIV-1 Env ectodomain or immunogenic fragment, vector or composition and a therapeutically effective amount of another anti-HIV agent, such as zidovudine, is administered to the mother and/or infant.

Administration of a therapeutically effective amount of a disclosed recombinant HIV-1 Env protein, immunogenic fragment thereof, protein nanoparticle, polynucleotide encoding a recombinant HIV-1 Env ectodomain or immunogenic fragment, vector or composition induces a sufficient immune response to treat or inhibit or prevent the pathogenic infection, for example, to inhibit the infection and/or reduce the signs and/or symptoms of the infection. Amounts effective for this use will depend upon the severity of the disease, the general state of the subject's health, and the robustness of the subject's immune system.

For prophylactic and therapeutic purposes, a therapeutically effective amount of a disclosed recombinant HIV-1 Env protein, immunogenic fragment thereof, protein nanoparticle, polynucleotide encoding a recombinant HIV-1 Env ectodomain or immunogenic fragment, vector or composition can be administered to the subject in a single bolus delivery, via continuous delivery (for example, continuous transdermal, mucosal or intravenous delivery) over an extended time period, or in a repeated administration protocol (for example, by an hourly, daily or weekly, repeated administration protocol). The therapeutically effective dosage of the therapeutic agents can be provided as repeated doses within a prolonged prophylaxis or treatment regimen that will yield clinically significant results to alleviate one or more symptoms or detectable conditions associated with a targeted disease or condition as set forth herein.

In several embodiments, a prime-boost immunization protocol is used, and a recombinant HIV-1 Env ectodomain trimer including that binds to mature and unmutated common ancestor (UCA) forms of multiple classes of broadly neutralizing antibodies (e.g., targeting the CD4 binding site and the V1V2 domain) is used for the prime, and (in some embodiments, also for the boost. Exemplary recombinant HIV-1 Env ectodomain fur use as a prime in such embodiments are provided herein and include those set forth as SEQ ID NOs: SEQ ID NOs: 2146, 2147, 2148, 2149, 2150, 2151, 2152, 2153, 2154, 2155, 2156, 2157, 2158, and 2159.

Determination of effective dosages in this context is typically based on animal model studies followed up by human clinical trials and is guided by administration protocols that significantly reduce the occurrence or severity of targeted disease symptoms or conditions in the subject, or that induce a desired response in the subject (such as a neutralizing immune response). Suitable models in this regard include, for example, murine, rat, porcine, feline, ferret, non-human primate, and other accepted animal model subjects known in the art. Alternatively, effective dosages can be determined using in vitro models (for example, immunologic and histopathologic assays). Using such models, only ordinary calculations and adjustments are required to determine an appropriate concentration and dose to administer a therapeutically effective amount of the composition (for example, amounts that are effective to elicit a desired immune response or alleviate one or more symptoms of a targeted disease). In alternative embodiments, an effective amount or effective dose of the composition may simply inhibit or enhance one or more selected biological activities correlated with a disease or condition, as set forth herein, for either therapeutic or diagnostic purposes.

Dosage can be varied by the attending clinician to maintain a desired concentration at a target site (for example, systemic circulation). Higher or lower concentrations can be selected based on the mode of delivery, for example, trans-epidermal, rectal, oral, pulmonary, or intranasal delivery versus intravenous or subcutaneous delivery. The actual dosage of disclosed recombinant HIV-1 Env ectodomain, immunogenic fragment thereof, protein nanoparticle, polynucleotide encoding a recombinant HIV-1 Env ectodomain or immunogenic fragment, vector or composition will vary according to factors such as the disease indication and particular status of the subject (for example, the subject's age, size, fitness, extent of symptoms, susceptibility factors, and the like), time and route of administration, other drugs or treatments being administered concurrently, as well as the specific pharmacology of the composition for eliciting the desired activity or biological response in the subject. Dosage regimens can be adjusted to provide an optimum prophylactic or therapeutic response. As described above in the forgoing listing of terms, a therapeutically effective amount is also one in which any toxic or detrimental side effects of the disclosed immunogen and/or other biologically active agent is outweighed in clinical terms by therapeutically beneficial effects.

A non-limiting range for a therapeutically effective amount of the disclosed immunogen (e.g., a recombinant HIV-1 Env protein, or nucleic acid encoding such protein, or nanoparticle including such protein) within the methods and immunogenic compositions of the disclosure is about 0.0001 mg/kg body weight to about 10 mg/kg body weight, such as about 0.01 mg/kg, about 0.02 mg/kg, about 0.03 mg/kg, about 0.04 mg/kg, about 0.05 mg/kg, about 0.06 mg/kg, about 0.07 mg/kg, about 0.08 mg/kg, about 0.09 mg/kg, about 0.1 mg/kg, about 0.2 mg/kg, about 0.3 mg/kg, about 0.4 mg/kg, about 0.5 mg/kg, about 0.6 mg/kg, about 0.7 mg/kg, about 0.8 mg/kg, about 0.9 mg/kg, about 1 mg/kg, about 1.5 mg/kg, about 2 mg/kg, about 2.5 mg/kg, about 3 mg/kg, about 4 mg/kg, about 5 mg/kg, or about 10 mg/kg, for example 0.01 mg/kg to about 1 mg/kg body weight, about 0.05 mg/kg to about 5 mg/kg body weight, about 0.2 mg/kg to about 2 mg/kg body weight, or about 1.0 mg/kg to about 10 mg/kg body weight.

In some embodiments, the dosage includes a set amount of a disclosed immunogen (e.g., a recombinant HIV-1 Env protein, or nucleic acid encoding such protein, or nanoparticle including such protein) such as from about 1-300 μg, for example, a dosage of about 1, 2, 3, 4, 5, 6, 7, 8, 9, 10, 15, 20, 30, 40, 50, 60, 70, 80, 90, 100, 150, 200, 250, or about 300 μg. The dosage and number of doses will depend on the setting, for example, in an adult or anyone primed by prior HIV infection or immunization, a single dose may be a sufficient booster. In naïve subjects, in some examples, at least two doses would be given, for example, at least three doses. In some embodiments, an annual boost is given, for example, along with an annual influenza vaccination.

Actual methods for preparing administrable compositions will be known or apparent to those skilled in the art and are described in more detail in such publications as *Remingtons Pharmaceutical Sciences,* $19^{th}$ Ed., Mack Publishing Company, Easton, Pa., 1995.

In several embodiments, it may be advantageous to administer the therapeutic agents disclosed herein with other agents such as proteins, peptides, antibodies, and other antiviral agents, such as anti-HIV agents. Examples of such anti-HIV therapeutic agents include nucleoside reverse transcriptase inhibitors, such as abacavir, AZT, didanosine, emtricitabine, lamivudine, stavudine, tenofovir, zalcitabine, zidovudine, and the like, non-nucleoside reverse transcriptase inhibitors, such as delavirdine, efavirenz, nevirapine, protease inhibitors such as amprenavir, atazanavir, indinavir, lopinavir, nelfinavir, osamprenavir, ritonavir, saquinavir, tipranavir, and the like, and fusion protein inhibitors such as enfuvirtide and the like. In some examples, the disclosed therapeutic agents are administered with T-helper cells, such as exogenous T-helper cells. Exemplary methods for producing and administering T-helper cells can be found in International Patent Publication WO 03/020904, which is incorporated herein by reference.

For any application, treatment with a disclosed recombinant HIV-1 Env protein, immunogenic fragment thereof, protein nanoparticle, polynucleotide encoding a recombinant HIV-1 Env ectodomain or immunogenic fragment, vector or composition can be combined with anti-retroviral therapy, such as HAART. Antiretroviral drugs are broadly classified by the phase of the retrovirus life-cycle that the drug inhibits. The therapeutic agents can be administered before, during, concurrent to and/or after retroviral therapy. In some embodiments, the therapeutic agents are administered following a course of retroviral therapy. The disclosed therapeutic agents can be administered in conjunction with nucleoside and nucleotide reverse transcriptase inhibitors (nRTI), non-nucleoside reverse transcriptase inhibitors (NNRTI), protease inhibitors, Entry inhibitors (or fusion inhibitors), Maturation inhibitors, or a broad spectrum inhibitors, such as natural antivirals. Exemplary agents include lopinavir, ritonavir, zidovudine, lamivudine, tenofovir, emtricitabine and efavirenz.

In some embodiments, a disclosed recombinant HIV-1 Env protein, immunogenic fragment thereof, protein nanoparticle, polynucleotide encoding a recombinant HIV-1 Env ectodomain or immunogenic fragment, vector or composition can be used as an immunogen to prime or induce an immune response (such as a T or B cell response) to HIV-1 in a subject. In some such embodiments, the T cell response is a $CD4^{+\ T\ helper\ cell\ response,\ such\ as\ a\ Th}1$ cell response.

In some embodiments, the disclosed recombinant HIV-1 Env protein, immunogenic fragment thereof, protein nanoparticle, polynucleotide encoding a recombinant HIV-1 Env ectodomain or immunogenic fragment, vector or composition is administered to the subject simultaneously with the administration of the adjuvant. In other embodiments, the recombinant HIV-1 Env protein, immunogenic fragment thereof, protein nanoparticle, polynucleotide encoding a recombinant HIV-1 Env ectodomain or immunogenic fragment, vector or composition is administered to the subject after the administration of the adjuvant and within a sufficient amount of time to induce the immune response.

The recombinant HIV-1 Env protein, immunogenic fragment thereof, protein nanoparticle, polynucleotide encoding a recombinant HIV-1 Env ectodomain or immunogenic fragment, vector or composition can be used in coordinate vaccination protocols or combinatorial formulations. In certain embodiments, combinatorial and coordinate immunization protocols employ separate immunogens or formulations, each directed toward eliciting an anti-HIV immune response, such as an immune response to HIV-1 Env. Separate immunogenic compositions that elicit the anti-HIV immune response can be combined in a polyvalent immunogenic composition administered to a subject in a single immunization step, or they can be administered separately (in monovalent immunogenic compositions) in a coordinate immunization protocol.

In one embodiment, a suitable immunization regimen includes at least two separate inoculations with one or more immunogenic compositions, with a second inoculation being administered more than about two, about three to eight, or about four, weeks following the first inoculation. A third inoculation can be administered several months after the second inoculation, and in specific embodiments, more than about five months after the first inoculation, more than about six months to about two years after the first inoculation, or about eight months to about one year after the first inoculation. Periodic inoculations beyond the third are also desirable to enhance the subject's "immune memory." The adequacy of the vaccination parameters chosen, e.g., formulation, dose, regimen and the like, can be determined by taking aliquots of serum from the subject and assaying antibody titers during the course of the immunization program. Alternatively, the T cell populations can be monitored by conventional methods. In addition, the clinical condition of the subject can be monitored for the desired effect, e.g., prevention of HIV-1 infection or progression to AIDS, improvement in disease state (e.g., reduction in viral load), or reduction in transmission frequency to an uninfected partner. If such monitoring indicates that vaccination is sub-optimal, the subject can be boosted with an additional dose of immunogenic composition, and the vaccination parameters can be modified in a fashion expected to potentiate the immune response. Thus, for example, the dose of the disclosed recombinant HIV-1 Env protein, immunogenic fragment thereof, protein nanoparticle, polynucleotide encoding a recombinant HIV-1 Env ectodomain or immunogenic fragment, vector or composition and/or adjuvant can be increased or the route of administration can be changed.

It is contemplated that there can be several boosts, and that each boost can be a different disclosed recombinant HIV-1 Env protein, immunogenic fragment thereof, protein nanoparticle, polynucleotide encoding a recombinant HIV-1 Env ectodomain or immunogenic fragment, vector or composition. It is also contemplated in some examples that the boost may be the same recombinant HIV-1 Env protein, immunogenic fragment thereof, protein nanoparticle, polynucleotide encoding a recombinant HIV-1 Env ectodomain or immunogenic fragment, vector or composition as another boost, or the prime.

The prime can be administered as a single dose or multiple doses, for example two doses, three doses, four doses, five doses, six doses or more can be administered to a subject over days, weeks or months. The boost can be administered as a single dose or multiple doses, for example two to six doses, or more can be administered to a subject over a day, a week or months. Multiple boosts can also be given, such one to five, or more. Different dosages can be used in a series of sequential inoculations. For example a relatively large dose in a primary inoculation and then a boost with relatively smaller doses. The immune response against the selected antigenic surface can be generated by one or more inoculations of a subject.

Upon administration of a disclosed recombinant HIV-1 Env protein, immunogenic fragment thereof, protein nanoparticle, polynucleotide encoding a recombinant HIV-1 Env ectodomain or immunogenic fragment, vector or composition of this disclosure, the immune system of the subject typically responds to the immunogenic composition by producing antibodies specific for HIV-1 Env protein. Such a response signifies that an immunologically effective dose was delivered to the subject.

An immunologically effective dosage can be achieved by single or multiple administrations (including, for example, multiple administrations per day), daily, or weekly administrations. For each particular subject, specific dosage regimens can be evaluated and adjusted over time according to the individual need and professional judgment of the person administering or supervising the administration of the immunogenic composition. In some embodiments, the antibody response of a subject will be determined in the context of evaluating effective dosages/immunization protocols. In most instances it will be sufficient to assess the antibody titer in serum or plasma obtained from the subject. Decisions as to whether to administer booster inoculations and/or to change the amount of the therapeutic agent administered to the individual can be at least partially based on the antibody titer level. The antibody titer level can be based on, for example, an immunobinding assay which measures the concentration of antibodies in the serum which bind to an antigen including, for example, a disclosed recombinant HIV-1 Env protein. The methods of using immunogenic composition, and the related compositions and methods of the disclosure are useful in increasing resistance to, preventing, ameliorating, and/or treating infection and disease caused by HIV (such as HIV-1) in animal hosts, and other, in vitro applications.

In certain embodiments, the recombinant HIV-1 Env protein, immunogenic fragment thereof, protein nanoparticle, polynucleotide encoding a recombinant HIV-1 Env ectodomain or immunogenic fragment, vector or composition is administered sequentially with other anti-HIV therapeutic agents, such as before or after the other agent. One of ordinary skill in the art would know that sequential administration can mean immediately following or after an appropriate period of time, such as hours, days, weeks, months, or even years later.

In additional embodiments, a therapeutically effective amount of a pharmaceutical composition including a nucleic acid encoding a disclosed recombinant HIV-1 Env ectodomain or immunogenic fragment thereof is administered to a subject, for example to generate an immune response. In one specific, non-limiting example, a therapeutically effective amount of a nucleic acid encoding a disclosed recombinant HIV-1 Env ectodomain or immunogenic fragment thereof, is administered to a subject to treat or prevent or inhibit HIV infection, or to induce an immune response to HIV-1 (such as to gp120) in the subject.

One approach to administration of nucleic acids is direct immunization with plasmid DNA, such as with a mammalian expression plasmid. As L. Kits Any immunodiagnostic or therapeutic reagents can be provided as components of a kit. Optionally, such a kit includes additional components including packaging, instructions and various other reagents, such as buffers, substrates, antibodies or ligands, such as control antibodies or ligands, and detection reagents. The kit can include a container and a label or package insert on or associated with the container. Suitable containers include, for example, bottles, vials, syringes, etc. The containers may be formed from a variety of materials such as glass or plastic. The container typically holds a composition including one or more of the disclosed recombinant HIV-1 Env proteins, immunogenic fragments thereof, protein nanoparticles, polynucleotides encoding a recombinant HIV-1 Env ectodomain or immunogenic fragment, vectors or compositions, which is effective for treating, preventing, diagnosing, monitoring HIV infection or immune response. In several embodiments the container may have a sterile access port (for example the container may be an intravenous solution bag or a vial having a stopper pierceable by a hypodermic injection needle). The label or package insert indicates that the composition is used for treating the particular condition.

The label or package insert typically will further include instructions for use of an antigen, or a nucleic acid or a viral vector encoding, expressing or including the antigen, for example, in a method of treating or preventing a HIV infection. The package insert typically includes instructions customarily included in commercial packages of therapeutic products that contain information about the indications, usage, dosage, administration, contraindications and/or warnings concerning the use of such therapeutic products. The instructional materials may be written, in an electronic form (such as a computer diskette or compact disk) or may be visual (such as video files). The kits may also include additional components to facilitate the particular application for which the kit is designed. The kits may additionally include buffers and other reagents routinely used for the practice of a particular method. Such kits and appropriate contents are well known to those of skill in the art.

EXAMPLES

The following examples are provided to illustrate particular features of certain embodiments, but the scope of the claims should not be limited to those features exemplified.

Example 1

Structure, Activation, and Immune Recognition of Prefusion HIV-1 Env

This example illustrates the structure, activation, and immune recognition of prefusion HIV-1 Env. The HIV-1-Env ectodomain trimer, comprising three gp120 and three gp41 subunits, is a conformational machine that facilitates HIV-1 entry by rearranging from a mature unliganded state, through receptor-bound intermediates, to a postfusion state. This example shows the structure at 3.5-Å resolution for an HIV-1-Env trimer bound by antibodies PGT122 and 35O22. This structure reveals the prefusion conformation of gp41, indicates rearrangements needed for fusion activation, and defines parameters of immune evasion for the antigenic target of most neutralizing antibodies. Prefusion gp41 encircles extended N- and C-terminal strands of gp120 with a 4-helix collar, which is fastened by insertion of a fusion peptide-proximal methionine into a gp41-tryptophan clasp. Spike rearrangements required for entry likely involve opening the clasp and expelling the termini. N-linked glycosylation and sequence-variable regions cover the mature ectodomain trimer: the prevalence and location of effective neutralizing responses from seroconverter and chronic cohorts are mapped, and alterations that stabilize its conformation are identified.

Initially synthesized as a gp160 precursor, which is cleaved into gp120 and gp41 subunits, the trimeric HIV-1-Env ectodomain trimer displays unusual posttranslational processing including the addition of 25-30 N-linked glycans per gp120-gp41 protomer, tyrosine sulfation, and slow signal peptide cleavage. It rearranges from a mature unliganded state that evades antibody recognition, through intermediate states that bind to receptors CD4 and co-receptor (either CCR5 or CXCR4), to a postfusion state (reviewed in Wyatt, R. & Sodroski, Science 280, 1884-1888, 1998). Over the last 20 years substantial atomic-level detail has been obtained on these states, including structures of receptor-bound gp120 (Kwong et al. Nature 393, 648-659, 1998), postfusion gp41 (Chan at al., Cell 89, 263-273, 1997; Weissenhorn et al., Nature 387, 426-430, 1997), and the trimeric arrangement of prefusion gp120 along with two gp41 helices, one of which was aligned in sequence (Chan at al., Cell 89, 263-273, 1997; Weissenhorn et al., Nature 387, 426-430, 1997). The prefusion structure of gp41 has, however, resisted atomic-level analysis. Because the primary structural rearrangement driving membrane fusion is the gp41 transition from prefusion to postfusion conformations, the lack of a prefusion gp41 structure has stymied attempts to provide a coherent picture of the conformational rearrangements the spike undergoes to facilitate entry.

Here, neutralizing antibodies PGT122 (Walker et al., Nature 477, 466-470, 2011) and 35O22 were used to capture the HIV-1 ectodomain trimer in a mature near-native state. Crystals of the antigen-binding fragments (Fabs) of these two antibodies were obtained in complex with a soluble, cleaved, Env trimer construct (BG505 SOSIP.664; Sanders et al., Journal of virology 76, 8875-8889, 2002; Julien et al., PNAS 110, 4351-4356, 2013; Sanders, PLoS pathogens 9, e1003618, 2013) and the structure of this elusive immunological target was determined at atomic-level detail. Analysis of this structure in the context of previously determined gp120 and gp41 structures affords a mechanistic understanding of the conformational transitions the ectodomain trimer undergoes to facilitate virus entry. Delineate aggregate parameters of glycan shielding and genetic variation were determined and a cohort serum was used to determine where the immune system succeeds in recognizing the HIV-1 ectodomain trimer. Analysis of the mature HIV-1-Env structure and its conformational rearrangements, combined with an understanding of its evasion from and vulnerabilities to the immune system, provide an information matrix which can be exploited to manipulate this critical vaccine target.

Structure determination and overall structure. Atomic-level information for virtually all of the HIV-1 Env ectodomain has been obtained as antibody-bound Env complexes (FIG. 17). FIG. 17 illustrates structure determination as deposited as PDB Accession Nos. 1GGI (Stanfield et al., *PNAS*, 90, 6325-6329, 1993), 1GC1 (Kwong et al., *Nature*, 393, 648-659, 1998), 1F58 (Stanfield et al., *Structure*, 7, 131-142, 1999), 1B03 (Tugarinov et al., *Nat. Struct. Biol.*, 6, 331-335, 1999), 2F5B (Pai et al., Patent No. CA2371929), 1TJI (Ofek et al., *J. Virol.*, 78, 10724-10737, 2004), 1TZG (Cardoso et al., *Immunity*, 22, 163-173, 2005), 2B4C (Huang et al., *Science*, 310, 1025-1028, 2005), 2CMR (Luftig et al., *Nat. Struct. Mol. Biol.*, 13, 740-747, 2006), 2FX7 (Cardoso et al., *J. Mol. Biol.*, 365, 1533-1544, 2007), 3JWD (Pancera et al., *PNAS*, 107, 1166-1171, 2010), 3U2S (McLellan et al., *Nature*, 480, 336-343, 2011), 4G6F (Huang et al., *Nature*, 491, 406-412, 2012), 4CC8 (Bartesaghi et al., *Nat. Struct. Mol. Biol.*, 20, 1352-1357, 2013), 4NCO (Julien et al. *Science* 342, 1477-1483, 2013), and 3J5M (Lymunkis et al., *Science*, 342, 1484-1490, 2013).

Figure 1B:
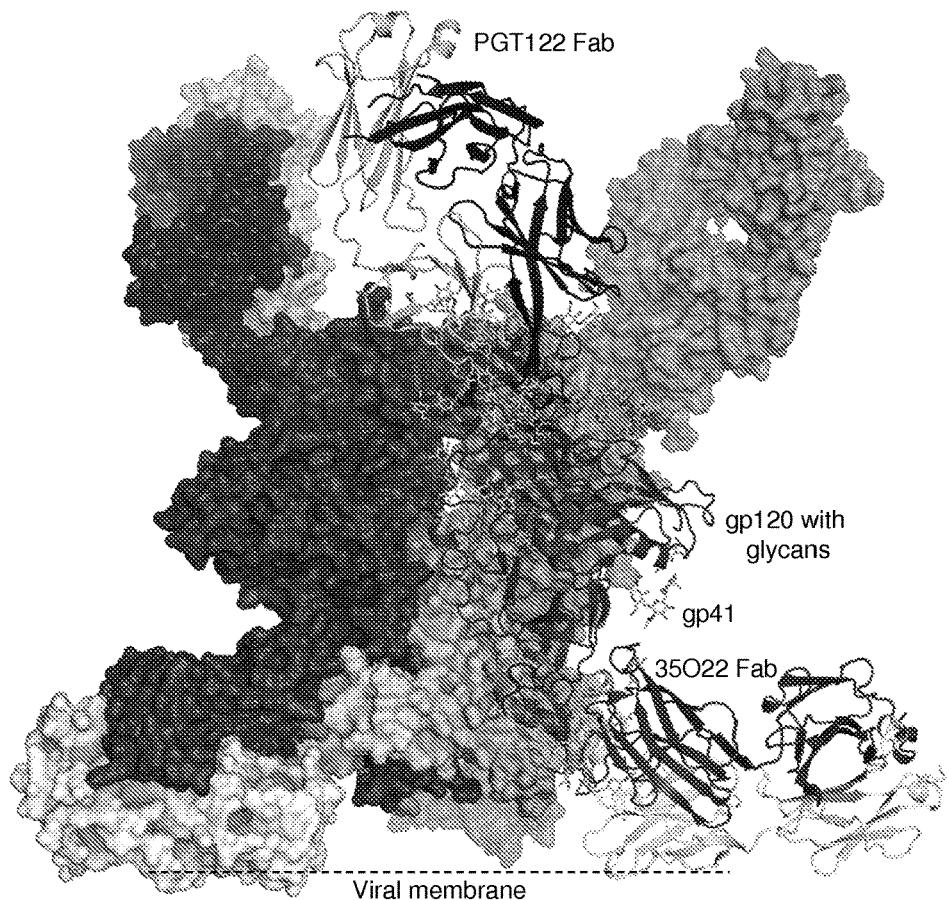
Figure 8A:
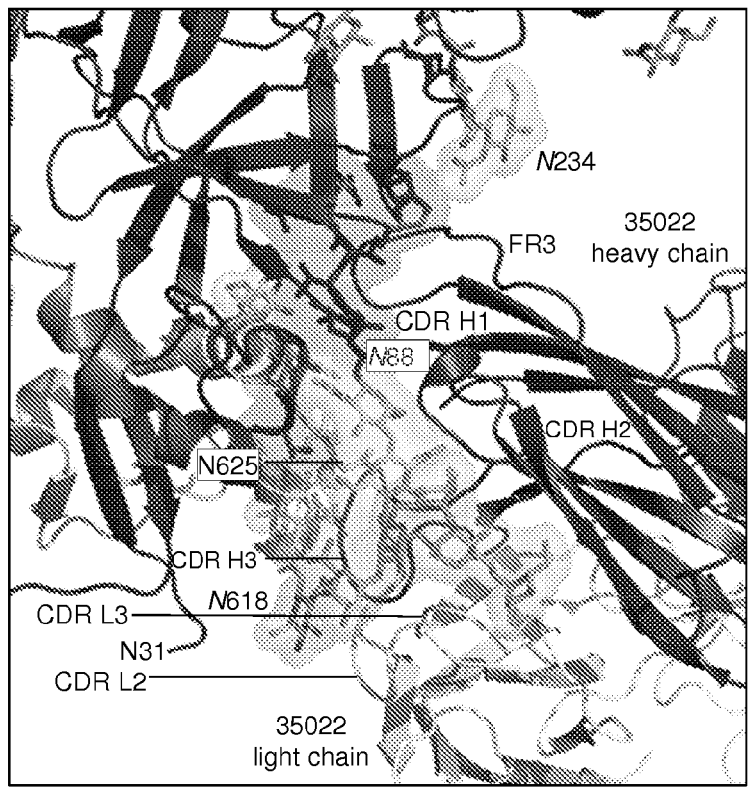
FIGS. 8A-8C show antibody 35O22 and interface details. Despite the substantial immune evasion protecting the mature unliganded state from humoral recognition, after several years of infection, the human immune system does generate broadly neutralizing antibodies. One of these is the 35O22 antibody, which neutralizes 62% of HIV-1 isolates at a median IC$_{50}$ of 0.033 μg/ml. 35O22 binds parallel to the viral membrane, at a gp120-gp41 epitope (FIG. 1B).
Figure 8B:
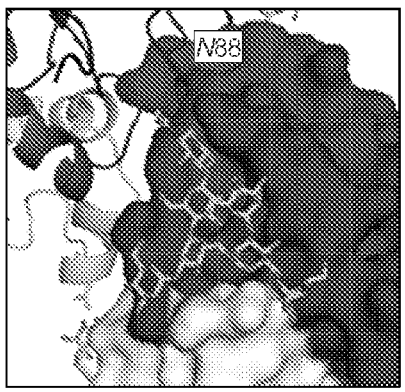
Figure 8C:
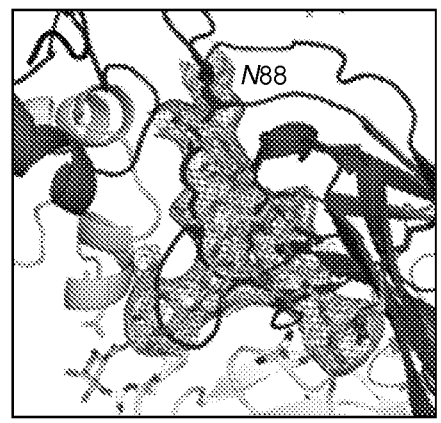

The recently determined electron microscopy (EM) reconstruction (Lyumkis et al., Science 342, 1484-1490, 2013) and crystal structure (Julien et al., Science 342, 1477-1483, 2013) of a soluble cleaved HIV-1 Env based on the BG505 SOSIP.664 construct were no exceptions, in particular—while an artificial disulfide and other modification of the SOSIP.664 construct were critical for production of homogeneous, soluble, cleaved trimers (Ringe et al., PNAS 110, 18256-18261, 2013)—antibody PGT122 appeared to facilitate crystallization of a near-native mature state (Julien et al., Science 342, 1477-1483, 2013). Diffraction from crystals of the PGT122 complex, however, extended to only 4.7-Å resolution hampering the trace of non-helical regions of gp41 as well as the placement and registry of side chains (Julien et al., Science 342, 1477-1483, 2013). Addition of antibody 35O22 to PGT122-bound viral spike in the membrane-bound virion context showed single-molecule fluorescent resonance energy transfer (smFRET) responses that closely resembled that of the mature native unliganded ectodomain trimer (FIG. 1*a*, FIG. 7; Munro et al. *Biophysical Journal* 104, 415A, 2013). In the context of crystallization, addition of 35O22 to the PGT122-BG505 SOSIP.664 complex led to ternary complex crystals in space group P6$_3$. While diffraction was anisotropic, we succeeded in collecting ~3.5-Å data from a single crystal (57.2% complete with 2.2 I/σ in the 3.49-3.68 Å shell with 3 I/σ measurements extending to 2.9 Å along the 6-fold axis) (FIG. 14; FIG. 18). Structure solution by molecular replacement with free structures of Fab PGT122 (Julien et al., *PLoS pathogens* 9, e1003342, 201) and Fab 35O22 and antibody-bound gp120 (Georgiev et al., Science 340, 751-756, 2013) followed by model building and refinement revealed a double antibody-bound protomer to occupy the asymmetric unit and led to an Rwork/Rfree of 21.35%/24.80%. The final model, comprising PGT122 and 35O22 Fabs, residues 31-505 of gp120 (except 185a-186 and 399-410 in variable regions V2 and V4, respectively) and residues 518-664 of gp41 (except 548-568) along with 22-N-linked glycans and 10-sulfate ions is shown in FIG. 1B (for clarity, from this point forwards in this Example, residue numbers are cited with a subscript defining the molecule). 35O22 interactions with the HIV-1-Env trimer are shown in FIG. 8, and comparison of bound vs. unbound Fab structures is shown in FIG. 9.

Overall, the HIV-1 ectodomain trimer forms a 3-blade propeller, capped at the membrane-distal apex by trimer association domains with antibodies PGT122 and 35O22 binding to membrane-distal and membrane-proximal ends, respectively, of the ectodomain trimer (FIG. 10). Protomer interactions occur through the trimer association domains at the membrane-distal portion of the ectodomain trimer and also through gp41, primarily between helical interactions around the trimer axis. No trimeric interactions are contributed by the gp120 core: indeed, a cleft or opening is found under the trimer association domains along the 3-fold axis where such associations might occur. The trimeric gp41 forms a platform, through which the gp120 termini extend towards the viral membrane (FIG. 1*b*). Unusually slow signal peptide cleavage, which keeps the N terminus of gp120 proximal to the membrane during the folding, may facilitate gp41 folding.

Prefusion structure of gp41. Prefusion gp41 wraps its hydrophobic core around extended N- and C-termini-strands of gp120 (FIG. 2*a*). It forms a 4-helix collar comprising helices α6 (Met530$_{gp41}$-Asn543$_{gp41}$), α7 (Gly572$_{gp41}$-Ile595$_{gp41}$—which aligns in sequence with the C-terminal portion of the postfusion HR1 helix), α8 (Leu619$_{gp41}$-Trp623$_{gp41}$), and α9 (Trp628$_{gp41}$-Asp664$_{gp41}$—which aligns in sequence with the postfusion HR2 helix) (the numbering of prefusion gp41-helices and -strands continues the nomenclature established for the gp120 subunit, which ends with helix α5 and strand β26). The first residue of gp41 visible in the electron density corresponds to Val518$_{gp41}$, in the fusion peptide. An extended stretch connects to Leu523$_{gp41}$, which interacts hydrophobically with Trp45$_{gp120}$ and Ile84$_{gp120}$, both of which are part of the 7-stranded β-sandwich around which the gp120-inner domain is organized (Pancera PNAS 107, 1166-1171, 2010; Finzi et al., Molecular cell 37, 656-667, 2010). The main chain of gp41 follows gp120-strand β0 away from the trimer axis towards the viral membrane, until residue Met530$_{gp41}$, where the fold reverses itself and extends through the α6 helix towards the trimer axis and away from the viral membrane. Density between residues 547$_{gp41}$ and 569$_{gp41}$ is sparse (FIG. 19), and ultimately connects to α7, which forms a coiled-coil with itself around the trimer axis, extending from the middle of the HIV-1 ectodomain trimer towards the viral membrane. At the end of α7 is the gp41-cysteine loop (spanned by the Cys598$_{gp41}$-Cys604$_{gp41}$ disulfide), whose C-terminal residues initiate strand β27 (Leu602$_{gp41}$-Thr606$_{gp41}$), which hydrogen bonds in anti-parallel fashion with strand β-4 from the N terminus of gp120. The inter-subunit disulfide ('SOS') between residues 501$_{gp120}$ and 605$_{gp41}$ welds the C terminus of gp120 to the membrane-proximal end of strand β-4 (FIG. 2*a*). These membrane-proximal interactions are further stabilized by hydrophobic interactions, which gp41 makes with the N and C termini of gp120—such as between Trp35$_{gp120}$ and Pro609$_{gp41}$ and between Trp610$_{gp41}$ and Pro498$_{gp120}$. Upon passing the gp120 termini, gp41 reaches α8, whose C terminus aligns spatially with the N terminus of α6. After α8, the α9 helix reverses direction, again wraps past the N- and C-termini of gp120, before extending horizontally along the rim of the ectodomain trimer to reach the gp120 termini from a neighboring protomer.

Topologically, the gp41 subunit completes a single circle around the gp120 termini with the insertion of a hydrophobic prong comprising the side chain of Met530$_{gp41}$ (which is located at the start of α6, proximal to the fusion peptide), into a triple tryptophan-clasp formed by Trp623$_{gp41}$ (from the end of α8), Trp628$_{gp41}$ (from the start of α9) and Trp631$_{gp41}$ (one turn into α9) (FIG. 2*a* insert). The alignment of dipoles from helices α6 and α8 likely provides electrostatic complementarity that help to stabilize the neighboring methionine-tryptophan clasp.

Within a single protomer, the buried surface between gp41 and gp120 totals 5,268 Å$^2$, including 216 Å$^2$ from glycan-protein interactions (FIG. 25). A substantial portion of this is hydrophobic: gp41 essentially wraps its hydrophobic core around the N- and C-termini of gp120 (FIG. 2*b*). Trimer interfaces also bury a large surface area (3,138 Å$^2$ contributed by each protomer, comprising 1,917 Å$^2$ from the gp41-gp41 interface, 861 Å$^2$ from the gp120-gp120 interface and 360 Å$^2$ from the gp120-gp41 interface) (FIGS. 20 and 25). Close to the trimer axis, these involve helix α7, as well as the N-terminal portion of the gp41-cysteine loop. Further from the trimer axis, interactions involve α9. Other than interactions of α7, most of the interprotomer interactions are hydrophilic (FIG. 2c, FIG. 20B). Overall, the prefusion structure of gp41 as well as its trimeric arrangement appears to have no close structural relatives in the PDB (FIG. 26).

Prefusion to postfusion gp41 transition. To understand the conformational transition from prefusion to postfusion gp41, the gp41-prefusion structure in the near-native HIV-1 Env trimer was compared with previously determined postfusion structures (FIG. 3). Several postfusion gp41 structures have been determined ranging from a minimal, protease-treated, crystal structure (residues $556_{gp41}$-$581_{gp41}$; $628_{gp41}$-$661_{gp41}$; PDB 1AIK; Chan at al., Cell 89, 263-273, 1997) with 80% sequence identity to BG505 (Wu et al. Journal of virology 80, 835-844, 2006) to a more complete gp41 structure (residues $531_{gp41}$-$581_{gp41}$; 624-$681_{gp41}$; PDB 2X7R; Buzon et al. PLoS pathogens 6, e1000880, 2010) and an NMR structure that includes the cysteine loop (residues $539_{gp41}$-$665_{gp41}$; PDB 2EZO; Caffrey, M. et al. *EMBO* 17, 4572-4584 (1998) of the simian immunodeficiency virus (SIV), which shares 48% sequence identity with BG505 (Wu et al. Journal of virology 80, 835-844, 2006) and is substantially similar to the HIV-1 structures (less than 1-Å Cα root-mean-square deviation (rmsd) between overlapping residues of 1AIK and 2EZO). To provide comparison with a "complete" postfusion structure, a chimera of HIV-1/SIV structures was prepared (FIG. 21). Distance difference analysis (FIG. 3B) of prefusion and postfusion structures indicated two regions of substantial similarity, corresponding to (i) the prefusion α7 helix aligned with the C-terminal half of the postfusion HR1 helix and (ii) the prefusion α9 helix aligned with much of the postfusion HR2 helix.

Superposition of prefusion α7 and postfusion HR1 placed residues $569_{gp41}$-$593_{gp41}$ within 5 Å, with a rmsd of 1.35 Å. For this superposition to occur, Cα-movements of over 80 Å are required for the gp41-fusion peptide and α6 helix as well as for the C-terminal portion of the α9 helix. Notably, this superposition preserves the coiled coil trimeric interaction of both prefusion and postfusion molecules and thus likely mimics the natural conformational transition that occurs during membrane fusion. Meanwhile, superposition of prefusion α9 and postfusion HR2 placed residues $634_{gp41}$-$664_{gp41}$ within 5 Å, with a rmsd of 3.58 Å; the substantial alignment of the α9 and HR2 helices indicate that the HR2 helix is mostly preformed in the prefusion structure.

Entry rearrangements of HIV-1 Env. Biosynthesis of HIV-1 Env starts with an uncleaved gp160 trimer. Binding by antibodies PG9 and PGT145 to both uncleaved and mature Env indicate the trimer association domains at the spike apex likely assume conformations similar to that observed for the mature ectodomain trimer (Walker et al., Nature 477, 466-470, 2011; Walker et al. *Science* 326, 285-289, 2009) (FIG. 27). The structure of gp41 in the uncleaved state remains unknown, but antigenic differences with the mature cleaved state (Blattner et al. Immunity 40, 669-680, 2014; Falkowska et al. Immunity 40, 657-668, 2014) suggest a distinct gp41 conformation; in the prefusion HIV-1-Env structure, the observed C terminus of gp120 at residue $505_{gp120}$ and N terminus of gp41 at residue $518_{gp41}$ are 37 Å apart, a distance which cleavage may help the prefusion structure to accommodate. After cleavage, the ectodomain trimer condenses into the closed near-native mature structure described here. In the gp120-inner domain, helix α-1 is formed, and a parallel strand exists between β3 and β21; in gp41, helix α7 was observed to begin around residue $571_{gp41}$. A partially open ectodomain trimer conformation has been reported at 6 Å by EM reconstruction (Bartesaghi, Nature structural & molecular biology 20, 1352-1357, 2013). The trimer association domains appear to be displaced from the trimeric axis, and helical density suggests helix α7 to start several turns earlier, extending ~20 Å towards the target cell membrane; we modeled these rearrangements with a rigid body motion of 6 degrees of the gp120 protomer and by the conversion of ~15 residues of helix α6 and connecting stretch into helix α7 (FIG. 3D, middle panel; 15).

The CD4-bound state has been visualized by a number of EM reconstructions (Liu, Nature 455, 109-113, 2008; White et al. PLoS pathogens 6, e1001249, 2010) and atomic-level structures (Kwong et al. Nature 393, 648-659, 1998; Pancera PNAS 107, 1166-1171, 2010). In this state, V1V2 separates from V3: V3 points towards the target cell (Huang et al. Science 310, 1025-1028, 2005), and the bridging sheet (Kwong et al. Nature 393, 648-659, 1998) assembles with β2 forming antiparallel hydrogen bonds with β21 (as opposed to the parallel β3-β21 interaction of the near-native mature state; notably, the only parallel β-strand in the RSV F glycoprotein prefusion structure also changes conformation in RSV F pre- to postfusion transition; McLellan et al. Science 340, 1113-1117, 2013). With layer 1 of the inner domain (Finzi et al., Molecular cell 37, 656-667, 2010), helix α0 forms and Gln428$_{gp120}$ and strand β21 invert; and in layer 2, inner domain rearrangements include the swapping of distinct perpendicular interactions of Trp112$_{gp120}$ and Trp427$_{gp120}$ (FIG. 11). CD4 binding allows HR2 peptide analogues (such as T20 or C34) to bind (Yuan et al., Journal of virology 78, 5448-5457, 2004; and helix α7 can be modeled starting as early as $554_{gp41}$ with Met530$_{gp41}$ still in its membrane-proximal tryptophan clasp (FIG. 22), as expected because 35O22 binds the CD4-bound SOSIP (FIGS. 16 and 23). It is expected that Env-CCR5 interactions (Huang et al., Science 317, 1930-1934, 2007) bring the CD4-bound state close to the target cell membrane, where the "de-assembling α6/assembling α7 helices" coupled to release of the Met530$_{gp41}$ prong from its tryptophan clasp ultimately amasses the gp41-fusion peptide(s) (FIG. 3d, 2nd panel from right).

At this receptor-bound stage, it is easy to imagine the fusion peptide penetrating the target cell membrane, while β27 gp41-cysteine loop remains hydrogen bonded to the gp120 termini (and with the C terminus of the gp41 ectodomain is in the viral membrane). Rearrangement of gp41 to its postfusion conformation may be triggered by gp120 shedding (Moore et al., *Science* 250, 1139-1142, 1990), with expulsion of its termini tugging on the gp41-cysteine loop and destabilizing the prefusion gp41 core. We note that the three tryptophans that make up the gp41-tryptophan clasp are essential to the folding of the post-fusion coiled coil, so they appear to be critical in both conformations (FIG. 24). The MPER region likely associates with a number of lipids assisting the fusion of viral and target cell membrane.

HIV-1 rearrangements and other type 1 fusion machines. To determine whether the distinct elements observed in prefusion gp41 were preserved elsewhere, prefusion and postfusion states of other type I fusion machines from influenza virus (a member of the Orthomyxoviridae family of viruses; Wilson et al., Nature 289, 366-373, 1981, Bullough et al., Nature 371, 37-43, 1994), respiratory syncytial virus (RSV; Paramyxoviridae, McLellan et al. Science 340, 1113-1117, 2013, McLellan et al., Journal of virology 85, 7788-7796, 2011), and Ebola virus (Filoviridae, Weissenhorn et al., Molecular cell 2, 605-616, 1998, Lee et al., Nature 454, 177-182, 2008) were examined (FIG. 4a). In all cases, a helix was observed in the gp41-prefusion equivalents, which corresponds in sequence to the C-terminal portion of the helix, which in the postfusion conformation, comprises the internal coiled coil characteristic of type I fusion machines (FIG. 4b). With prefusion machines from HIV-1, influenza, and Ebola, the nascent prefusion helix adopts a coiled coil; with RSV, a coiled coil assembles immediately N terminal to the nascent postfusion helix. Despite dramatic differences in gp120-equivalents, similarity is also observed in the overall topology of subunit interactions. Notably, all of the gp41-equivalents wrap hydrophobic residues around extended termini (or terminus) of their gp120-equivalents (FIG. 4c). With influenza, it is only the N terminus of the gp120-equivalent (HA1) that is wrapped by the gp41-equivalent (HA2), with the N terminus of HA2 completing about 20% more than a single encirclement. With RSV, it is also only the N terminus of the gp120 equivalent (F2) that is wrapped by the gp41-equivalent (F1), and the termini do not have to be expelled to transition to the postfusion form. With Ebola, the gp41-equivalent (gp2) wraps around both N and C termini-strands of the gp120-equivalent (gp1), completing about 70% of a single encirclement. Overall, the similarity in prefusion folding topology and in prefusion and post-fusion inner helices observed here, along with the previously observed similarity in postfusion coiled coils (reviewed in Colman et al., Nature reviews. Molecular cell biology 4, 309-319, 2003), provide a more general and integrated view of the conformational rearrangements that type 1 fusion machines undergo to facilitate virus-cell membrane fusion.

Figure 5A:
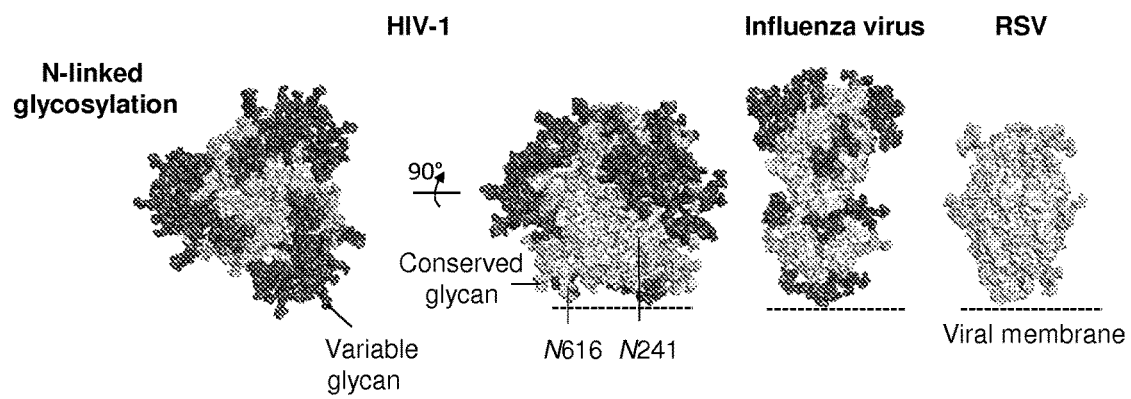
FIGS. 5A-5C illustrate the fully assembled shield revealed by prefusion HIV-1 gp120-gp41 trimer.

Glycan shield and genetic variation of mature unliganded Env. The mature unliganded conformation of HIV-1 Env is the target of most neutralizing antibodies. Substantial detail has already been reported regarding antibody recognition of gp120 in this conformation (Julien et al., Science 342, 1477-1483, 2013; Lyumkis et al., Science 342, 1484-1490, 2013). The newly revealed structure of a near-complete gp120-gp41 Env trimer provides an opportunity to understand aggregate properties of glycosylation and variation. Glycan shielding and genetic variation have long been recognized as mechanisms to avoid recognition by antibody (Wyatt et al., Nature 393, 705-711., 1998). The BG505 SOSIP.664 sequence contains 28 sequons specifying N-linked glycosylation (including a T332N mutation). We modeled high mannose glycans (either Man9 or Man5) on each sequon and calculated accessible surface for radii ranging from 1.4 Å (the radius of a water molecule) to 10 Å (the approximate radius of a single immunoglobulin domain) (FIG. 12). In the Man9-glycosylated structure, 29% of the protein surface was solvent accessible, whereas only 3% of the surface was immunoglobulin-domain accessible. By contrast, with the fusion glycoproteins from influenza and RSV, 14% and 48%, respectively, of these surfaces were immunoglobulin-domain accessible (FIG. 5a).

Figure 5B:
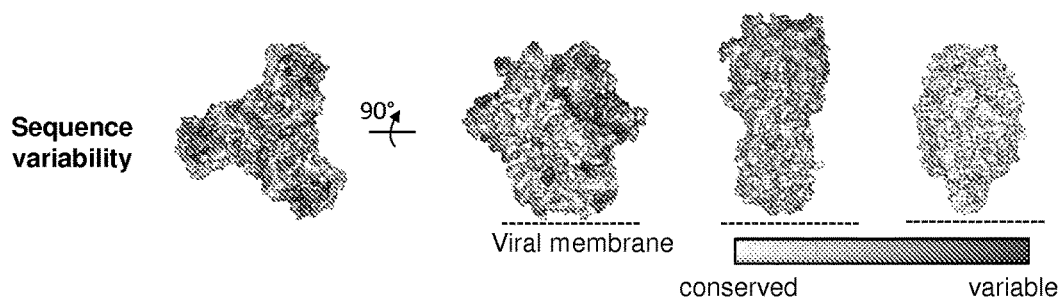
Figure 5C:
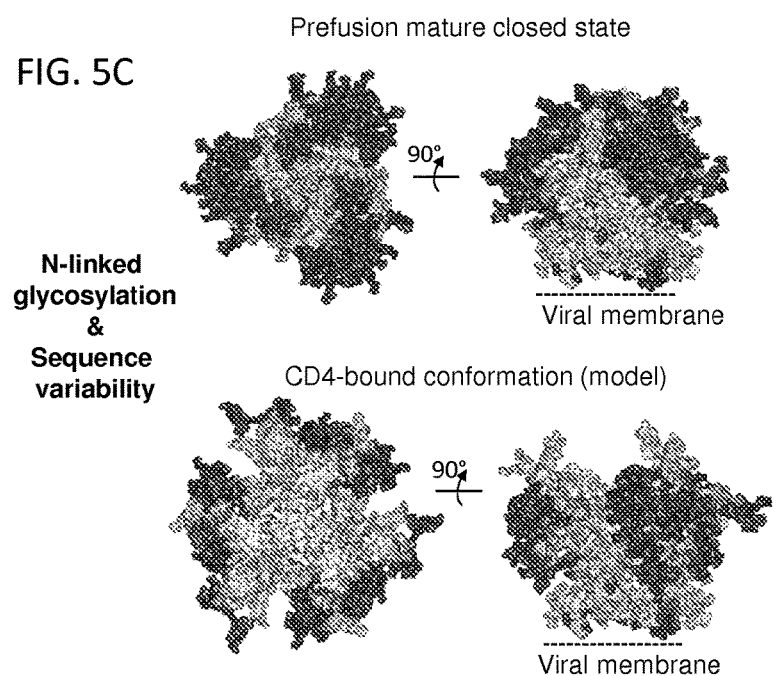

In terms of genetic variation, the per-residue Shannon entropy of 3,943 sequences of HIV-1 was calculated (FIG. 5b). Approximately 50% of the surface was shown to have a variability of greater than 10%, a degree of surface variation shared by influenza, but not by RSV. When glycan shielding and genetic variation were combined, only ~2% of the surface was immunoglobulin accessible with a variability of less than 10% (FIG. 5c, upper panels); much of this conserved surface occurred at the membrane-proximal "base" of the ectodomain trimer, which is expected to be sterically occluded by the viral membrane. To determine how this fully assembled shield compared to other conformations, the immunoglobulin accessibility of the CD4-bound conformation was also assessed (FIG. 5c). Notably the CD4-bound conformation showed substantially higher percentage of glycan-free, conserved surface, providing insight into the greater ease by which antibodies reactive with the CD4-bound conformation are elicited—and by contrast, the difficulty in eliciting broadly neutralizing antibodies against the variable, glycan-covered mature state.

Serologic recognition of mature Env. Despite the multiple mechanisms of evasion shielding mature HIV-1 Env, potent broadly neutralizing antibodies do develop (Hraber et al. AIDS 28, 163-169, 2014). Many of these, including the PGT122 and 35O22 co-crystallized here, require N-linked glycosylation to bind; indeed, 35O22 utilizes a new mode of glycan recognition, involving a framework 3 insertion to create a "bowl" that cups glycan $N88_{gp120}$ (FIG. 8). The near-native mature prefusion structure of HIV-1 Env allows us to map known epitopes (FIG. 6a) and to compare the recognition of broadly neutralizing HIV-1 antibodies, with those capable of neutralizing influenza virus and RSV. Notably, the epitopes for broadly neutralizing HIV-1 antibodies were significantly more glycosylated and variable (FIG. 6b).

Figure 6D:
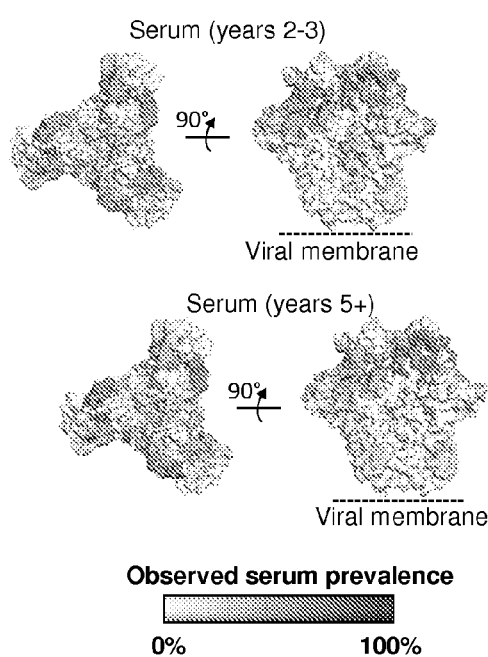
Figure 6E:
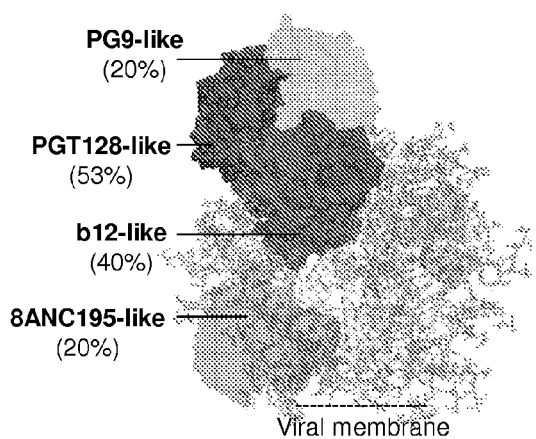
Figure 7A:
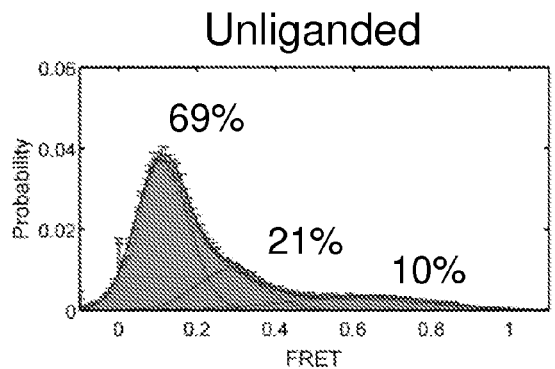
FIGS. 7A-7D show smFRET of HIV-1 Env in the context of infectious JR-FL virions. HIV-1$_{JR-FL}$ gp160 was labelled with fluorescent dyes in variable regions V1 and V4 at positions that did not interfere with Env function, and virus was surface immobilized for imaging via total internal reflection fluorescence microscopy (Munro, et al. *Biophysical Journal* 104, 415A (2013)). smFRET trajectories were compiled into histograms for the HIV-1$_{JR-FL}$ Env trimer, either unliganded or after pre-incubated for 30 min with 0.1 mg/ml PGT122, 35O22, or both PGT122 and 35O22 prior to imaging. Resultant Env conformational landscapes could be deconvoluted into three gaussian distributions: a low-FRET population that predominated for the prefusion mature unliganded state, and intermediate- and high-FRET populations, which predominated in the presence of CD4 receptor and CD4-induced antibody (Munro, et al. *Biophysical Journal* 104, 415A (2013)).
Figure 7B:
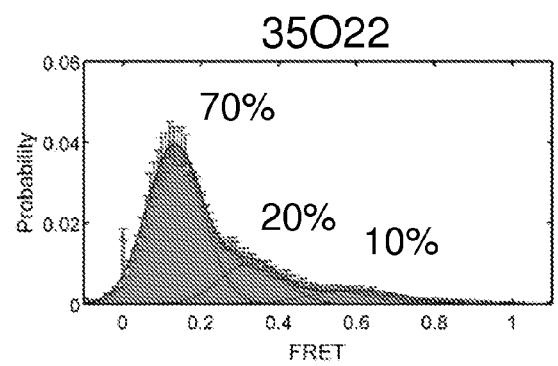
Figure 7C:
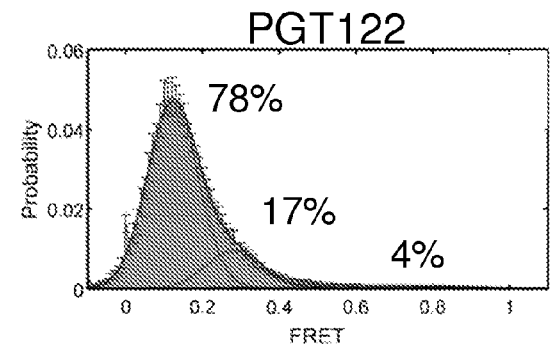
Figure 7D:
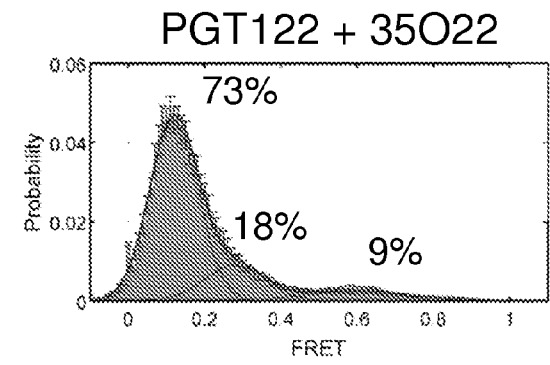
Figures 13A, 13B:
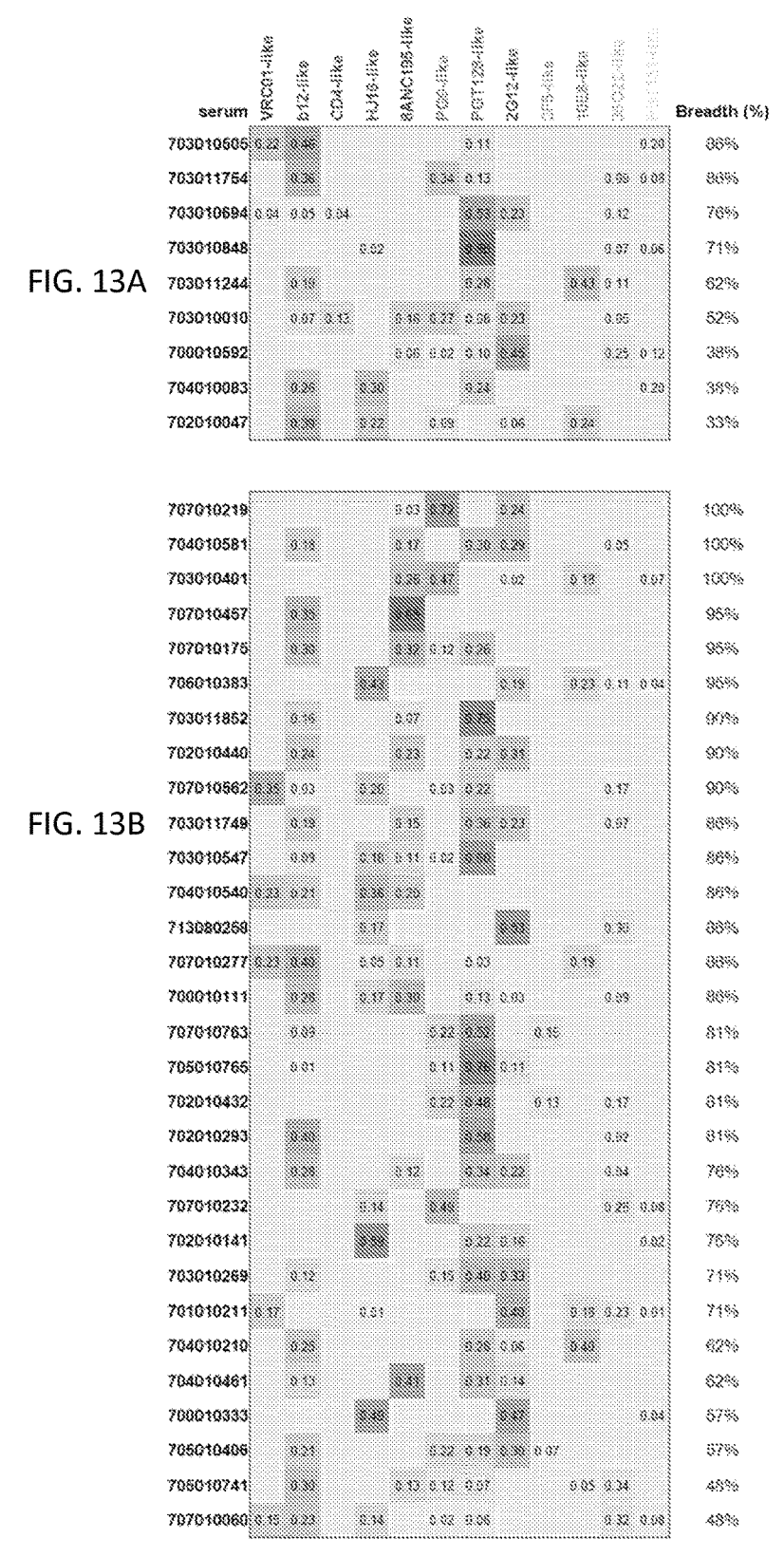

To determine the location and prevalence of effective humoral responses, a serological analysis was used that determined sites of HIV-1 vulnerability to antibody based on serum neutralization of a panel of diverse HIV-1 isolates (Georgiev et al., Science 340, 751-756, 2013). Sera from a cohort that had been infected for 2-3 years as well as sera from a cohort of donors that had been infected for more than 5 years were assessed on a panel of 21 diverse HIV-1 isolates, and the neutralization phenotypes assigned to 12 prototypic antibody-neutralization fingerprints (FIG. 6c, FIG. 13). We then mapped the responses to the surface of the near-native mature HIV-1-Env ectodomain trimer (FIG. 6d). The most prevalent response corresponded to the glycan V3 epitope epitomized by antibody PGT128. CD4-binding site-directed responses and also V1V2-directed responses were prevalent. Overall, responses to both cohorts were highly correlated indicating little evolution in the location or prevalence of effective neutralizing responses between 2-3 years and 5+ years. Notably, when mapping Env sites of vulnerability to neutralizing antibody, the majority of prevalent sites corresponded to Env surfaces covered by N-linked glycosylation and/or of high sequence variability. Overall, mapping of the location of cohort humoral responses directly visualized prevalent targets of vaccine relevance (FIG. 6e).

Viral evasion and immune recognition. In addition to merging virus and host cell membranes as an essential step in entry, viral fusion machines must contend with antibody-mediated neutralization. With RSV, peak infection occurs at 6-12 months of life, when maternal antibodies wane; with influenza virus, natural infection elicits strain-specific antibodies, and evasion occurs seasonally on a global scale. HIV-1, however, confronts the immune system in each individual directly, often presenting high titers of Env antigens over years of chronic infection. These differences in evasion are reflected in structural difference in the fusion machines. The structure of the HIV-1-Env ectodomain trimer revealed here allows the molecular trickery behind single spike entry (Yang et al., Journal of virology 79, 12132-12147, 2005), glycan shielding (Wei, X. et al. Antibody neutralization and escape by HIV-1. Nature 422, 307-312, 2003), and conformational masking (Kwong et al. Nature 420, 678-682, 2002) to be visualized at the atomic level (FIG. 31). Thus, avoidance of antibody avidity through the ability of a single HIV-1 spike to fuse viral and target cell membranes (Yang et al., *Journal of virology* 79, 12132-12147, 2005) is likely assisted by the membrane-proximity of the co-receptor and the membrane-associating MPER regions (FIG. 3); despite these differences, the HIV-1-Env ectodomain trimer appears to share mechanism and topology with other type 1 fusion machines (FIG. 4). In terms of glycan shielding (Wei, X. et al. Antibody neutralization and escape by HIV-1. *Nature* 422, 307-312, 2003), we have modeled the structure of a fully assembled glycan shield for a tier II transmitted founder virus (Wu et al. Journal of virology 80, 835-844, 2006) (FIG. 5). While glycan masking appears complete at the HIV-1-spike apex, closer to the membrane substantial "holes" are observed. And with conformational masking (Kwong et al. *Nature* 420, 678-682, 2002), evasion is optimal for the prefusion mature closed state, with CD4-binding unmasking conserved glycan-free surfaces (FIG. 5c). Despite extraordinary glycosylation and sequence variation, the human immune system appears up to the challenge of generating broadly neutralizing antibodies (FIG. 6). It is noted that recognition of glycosylation appears to be a trait common only to broadly neutralizing HIV-1 antibodies, although broad influenza virus-neutralizing antibodies do appear to tolerate epitope-sequence variation (FIG. 6b). The structure of the HIV-1-Env ectodomain trimer described here thus reveals not only commonalities in entry and evasion with other type 1 fusion machines, but also commonalities in recognition by the human immune system.

Methods

BG505 SOSIP.664 expression and purification. The crystallized HIV-1-Env construct from strain BG505 was synthesized as described in (Julien et al., *Science*, 342, 1477-1483, 2013; Julien et al., *Proc. Nat'l. Acad. Sci. U.S.A.*, 110, 4351-4356, 2013; Sanders et al., *PLoS pathogens*, 9, e1003618, 2013), using BG505 GenBank® Acc. Nos., using BG505 GenBank accession numbers ABA61516 and DQ208458 (Wu et al. Journal of virology 80, 835-844, 2006), including the "SOS" mutations (A501C, T605C), the isoleucine to proline mutation at residue 559 (I559P), and the glycan site at residue 332 (T332N); mutating the cleavage site to 6R (REKR to RRRRR); and truncating the C terminus to residue 664 (all HIV-1 Env numbering according to the HX nomenclature). This construct is referred to as BG505 SOSIP.664 herein.

The construct was cotransfected with furin in HEK 293 S GnTI-/- cells using 600 µgs plasmid DNA and 150 µgs of furin as described previously (Sanders, *PLoS pathogens* 9, e1003618, 2013). Transfection supernatants were harvested after 7 days, and passed over either a 2G12 antibody- or VRC01 antibody-affinity column. After washing with PBS, bound proteins were eluted with 3M $MgCl_2$, 10 mM Tris pH 8.0. The eluate was concentrated to less than 5 ml with Centricon-70 and applied to a Superdex 200 column, equilibrated in 5 mM HEPES, pH 7.5, 150 mM NaCl, 0.02% azide. The peak corresponding to trimeric HIV-1 Env was identified, pooled, and concentrated or flash-frozen in liquid nitrogen and stored at −80° C.

Fab expression and purification. PGT122 and 35O22 IgGs were expressed as previously described (McLellan et al., *Nature* 480, 336-343, 2011). Heavy chain plasmids containing an HRV3C cleavage site after Lys 218 in the hinge region were co-transfected with light chain plasmids in 293F (35O22) or GnTI-/- (PGT122, which is glycosylated) using TrueFect-Max transfection reagent (United Biosystems) according to manufacturer's protocol. Cultures were fed with fresh 293FreeStyle media (Life Technologies) 4 h post-transfection and with HyClone SFM4HEK293 enriched medium (HyClone) containing valproic acid (4 mM final concentration) 24 h after transfection. Cultures were then incubated at 33° C. for 6 days, and supernatants harvested and passed over a protein A affinity column. After PBS wash and low pH elution, pH of eluate was neutralized with 1M Tris pH 8.5. Fabs were obtained using HRV3C digestion and collecting flow-thru from protein A column to remove Fc fraction. Fabs were further purified over Superdex 200 in 5 mM HEPES, pH 7.5, 150 mM NaCl, 0.02% azide.

Ternary complex preparation. PGT122 and 35O22 Fabs were added to a solution of purified trimeric BG505 SOSIP.664 in 5 fold molar excess for 30 min at room temperature (RT). The complex was then partially deglycosylated by adding Endo H (50 µl) for 1 hour at RT in the gel filtration buffer. The complex was then purified over gel filtration equilibrated in 5 mM HEPES, pH 7.5, 150 mM NaCl, 0.02% azide. Fractions were pooled, concentrated down to 5-10 $OD_{280}$/mL and used immediately for crystal screening or flash frozen in liquid nitrogen and kept at −80° C. until further use.

Crystallization screening. The ternary complex was screened for crystallization using 572 conditions from Hampton, Wizard and Precipitant Synergy (Majeed, S. et al. *Structure* 11, 1061-1070 (2003) screens using a Cartesian Honeybee crystallization robot as described previously (McLellan et al., *Nature* 480, 336-343, 2011) and a mosquito robot using 0.1 µl of reservoir solution and 0.1 µl of protein solution. Crystals suitable for structural determination grew in 0.2M $Li_2SO_4$, 6.65% PEG 1500, 20% isopropanol and 0.1M sodium acetate pH 5.5. Crystals were reproduced in hanging droplets containing 0.5 µl of reservoir solution and 0.5 µl of protein solution. The final crystals were obtained in 16% isopropanol, 5.32% PEG 1500, 0.2M $Li_2SO_4$, 0.1M Na acetate pH 5.5. The crystals were cryoprotected in a solution of 15% 2R3R-butanediol, 5% isopropanol in paratone N and data were collected at a wavelength of 1.00 Å at the SER-CAT beamline ID-22 (Advanced Photon Source, Argonne National Laboratory).

X-ray data collection, structure solution and model building. Diffraction data were processed with the HKL2000 suite (Otwinowski and Minor, *Meth. Enzymol.*, 276, 307-326, 1997). The data were corrected for anisotropy by services.mbi.ucla.edu/anisoscale/with truncations to 3.5 Å, 3.5 Å, 3.1 Å along a, b, and c axes, respectively. Structure solution was obtained with Phaser using gp120 (PDB ID: 4J6R; Georgiev et al., Science 340, 751-756, 2013), PGT122 (PDB ID: 4JY5; Julien et al., *PLoS pathogens* 9, e1003342, 2013) and 35O22Fv as search models. Refinement was carried out with Phenix (Adams et al. *J Synchrotron Radiat*, 11, 53-55, 2004) imposing PGT122, 35O22 and gp120 model-based refinement restraint during initial round of refinement. Model building was carried out with Coot (Emsley and Cowtan, *Acta crystallographica. Section D, Biological crystallography*, 60, 2126-2132, 2004). The Ramachandran plot as determined by MOLPROBITY (Davis et al., *Nucleic Acids Res*, 32, W615-619, 2004) showed 92.66% of all residues in favored regions and 99.03% of all residues in allowed regions. Data collection and refinement statistics are shown in FIG. 14.

SmFRET. Peptides for site-specific fluorescent labeling were inserted into HIV-1$_{JR-FL}$ gp160 at positions that did not interfere with Env function by overlap extension PCR. Tagged virus was purified and labelled with Cy3B and Cy5(4S)COT fluorophores, and surface immobilized for imaging via total internal reflection fluorescence (TIRF)

microscopy as described (Munro et al. *Biophysical Journal* 104, 415A, 2013). Labelled virus was pre-incubated for 30 min with 0.1 mg/ml PGT122 or 35O22, or with both PGT122 and 35O22 prior to imaging. Fluorescence trajectories were acquired at 25 frames/s. Traces that presented anticorrelated fluctuations in fluorescence intensity, indicative of FRET, were identified and compiled into histograms. Histograms were fit to the sum of three Gaussian distributions in Matlab. smFRET revealed that HIV-1 Env is conformationally dynamic, transitioning between three distinct conformations. Response to various ligands identified the low-FRET conformation as the predominant population of mature prefusion unliganded HIV-1 Env; intermediate- and high-FRET conformations predominant in the presence of CD4 and CD4-induced antibodies (Munro et al. *Biophysical Journal* 104, 415A, 2013).

Binding studies using biolayer interferometry. A forteBio Octet Red384 instrument was used to measure binding of BG505 SOSIP. 664 and BG505 gp120 molecules to neutralizing antibodies (VRC01, VRC03, b6, b12, F105, PGT122, PGT128, PGT135, 2G12, 8ANC195, 17b, 2.2C, 412d, PG9, PGT145, VRC26.09, 35O22, PGT151) and CD4 Ig. All the assays were performed with agitation set to 1,000 rpm in phosphate-buffered saline (PBS) buffer supplemented with 1% bovine serum albumin (BSA) in order to minimize nonspecific interactions. The final volume for all the solutions was 40-50 µl/well. Assays were performed at 30° C. in solid black tilted-bottom 384-well plates (Geiger Bio-One). Human antibodies (40-50 µg/ml) in PBS buffer was used to load anti-human IgG Fc capture (AHC) probes for 300 s. Typical capture levels were between 1 and 1.5 nm, and variability within a row of eight tips did not exceed 0.1 nm. Biosensor tips were then equilibrated for 180 s in PBS/1% BSA buffer prior to binding assessment of the BG505 SOSIP.664 and BG505 gp120 molecules in solution for 300 s; binding was then allowed to dissociate for 300 s. Parallel correction to subtract systematic baseline drift was carried out by subtracting the measurements recorded for a sensor without monoclonal antibody incubated in PBS/1% BSA. Data analysis were carried out using Octet software, version 8.0.

Difference distance analysis. Difference distance matrices were produced by distance sorting atom positions and plotting with the program DDMP (Nishikawa et al., *J. Physical Society of Japan* 32, 1331-1337 (1972).

Surface plasmon resonance analysis. Affinities and kinetics of binding of antibodies 35O22 and PGT151 to BG505 SOSIP.664 soluble trimer were assessed by surface plasmon resonance on a Biacore T-200 (GE Healthcare) at 20° C. with buffer HBS-EP+ (10 mM HEPES, pH 7.4, 150 mM NaCl, 3 mM EDTA, and 0.05% surfactant P-20). In general, mouse anti-human Fc antibody was first immobilized onto two flow cells on a CM5 chip at ~10000 response units (RU) with standard amine coupling protocol (GE Healthcare). Either CD4-Ig, 2G12 IgG or 17b IgG was then captured on both flow cells by flowing over a 200 nM solution at 5 l/min flow rate for two minutes. This was followed by a 1-minute injection of 1 µM human Fc on both flow cells to block unliganded mouse anti-human Fc antibody. The captured 2G12, CD4 or 17b were used to immobilize BG505 SOSIP.664 trimer on only one flow cell, with no trimer captured on the other flow cell (reference cell). For capturing with 2G12 or CD4-Ig, 500 nM of unliganded trimer was used, whereas, a complex of 500 nM trimer+1500 nM sCD4 was used for capturing with 17b. Antibody Fab fragments at 2-fold dilutions starting from 885 nM, 600 nM and 460 nM for 35O22, PGT151 and PGT145, respectively, were injected over the captured trimer channel and the reference channel at a flow rate of 50 µl/min for 2 minutes and allowed to dissociate for 3-30 minutes depending on the rate of dissociation of each interaction. The cells were regenerated with two 10 µl injections of 3.0 M $MgCl_2$ at a flow rate of 100 µl/min. Blank sensorgrams were obtained by injection of same volume of HBS-EP+ buffer in place of antibody Fab fragments. Sensorgrams of the concentration series were corrected with corresponding blank curves and fitted globally with Biacore T200 evaluation software using a 1:1 Langmuir model of binding. The stoichiometry of binding of antibodies to the trimer were estimated by normalizing the Rmax values to the amount of trimer captured and performing linear regression analysis using the Rmax values for the antibodies with known stoichiometries.

Modeling of missing loops, side chains, and the N-linked glycan shield. Missing loops not defined in the HIV-1-Env trimer crystal structure were modeled using Loopy (Xiang et al., *Proc. Nat'l. Acad. Sci. U.S.A.*, 99, 7432-7437, 2002). The Missing side chains were modeled with Scap (Xiang and Honig, *J Mol. Biol.*, 311, 421-430, 2001).

To model the N-linked glycan shield, we first determined all possible N-linked sequons in the HIV-1 Env trimer structure. A single asparagine residue in each sequon was targeted for computational N-linked glycan addition using a series of oligmannose 9 rotamer libraries at different resolutions. In constructing the rotamer libraries, the asparagine side chain rotamers were also considered. To avoid a combinatorial explosion in the search space, select torsion angles in the oligomannose 9 rotamer libraries were allowed to vary in increments between 30-60 degrees. An overlap factor (ofac) was used to screen for clashes between the sugar moieties and the trimer structure. The ofac between two nonbonded atoms is defined as the distance between two atoms divided by the sum of their van der Waal's radii. For the modeling carried out here, the ofac was set to a value of 0.60. For sterically occluded positions, the ofac was set to 0.55. To remove steric bumps between sugar moieties, all models were subjected to 100 cycles of conjugate gradient energy minimization using the GLYCAM (Kirschner et al. Journal of computational chemistry 29, 622-655 (2008)) force field in Amber12 (Cornell J. Am. Chem. Soc. 117, 5179-5197, 1995). with a distance-dependent dielectric.

Mapping sequence variability onto trimer structure. For each of HIV-1 Env, influenza HA, and RSV F, residue sequence variability was computed as the Shannon entropy for each residue position, based on representative sets of 3943 HIV-1 strains, 4467 influenza strains, and 212 RSV strains, respectively. Residues were colored based on the computed entropy values, on a scale of white (conserved) to purple (variable).

Serum neutralization fingerprinting analysis. The prevalence of effective neutralizing responses against HIV-1 Env in cohorts from 2-3 and 5+ years post-infection was estimated using a neutralization fingerprinting approach, as described previously (Georgiev et al., *Science*, 340, 751-756, 2013). Briefly, serum neutralization over a set of 21 diverse viral strains was compared to neutralization of the same viruses by a set of broadly neutralizing antibodies grouped into 12 epitope-specific antibody clusters. For each serum, the relative prevalence of each of the 12 antibody specificities was estimated by representing serum neutralization as a linear combination of the monoclonal specificities, with prevalence values of 0.2 deemed as positive. Sera with less than 30% breadth on the 21-virus panel as well as sera with high residual values from the computation (data not shown) were not included in the analysis. For mapping prevalence values onto the BG505 structure, residues part of multiple antibody epitopes were colored according to the respective antibody specificity with the highest prevalence in the 5+ years cohort. Antibody neutralization was measured using single-round-of-infection HIV-1 Env-pseudoviruses and TZM-bl target cells, as described previously (Li et al., *J. Virol.*, 79, 10108-10125, 2005). Neutralization curves were fit by nonlinear regression using a 5-parameter hill slope equation as previously described (Li et al., *J. Virol.*, 79, 10108-10125, 2005).

Patient information. In the CHAVI 001 cohort, high-risk subjects were screened for HIV-1 infection by ELISA, Western blotting, and plasma RNA to recruit individuals with acute HIV infection, who were then followed for ~2 years until plasma neutralization breadth developed (Tomaras et al., *J. Virol.*, 82, 12449-12463, 2008). In addition, a group of individuals were enrolled in the CHAVI 001 or CHAVI 008 cohorts who were chronically infected with HIV-1 strains clade A, B or C, and were screened for plasma neutralization breadth. The trial participants were enrolled at sites in Tanzania, South Africa, Malawi, the United States, and the United Kingdom (Tomaras et al., *J. Virol.*, 85, 11502-11519, 2011). Both CHAVI001 and CHAVI008 protocols were approved by the institutional review boards of each of the participating institutions where blood samples were received or processed for analysis.

Epitope analysis for HIV-1 Env, influenza HA, and RSV F antibodies. Glycan usage and average residue entropy were calculated for eight representative HIV-1 Env (VRC01, b12, CD4, HJ16, 8ANC195, PG9, PGT122, 2G12, and 35O22), four representative influenza HA (2D1, C05, F10, and CR8043), and three representative RSV F (D25, Motavizumab, and 101F) epitopes based on their respective crystal structures. The selection of the flu antibodies was done as follows: F10 (stem targeting) and C05 (head targeting) were selected based on their cross-neutralizing ability for group 1 and group 2 of influenza A. CR8043 (group 2 specific) and 2D1 (H1 specific), which targets distinct regions from F10 and C05 at the stem and head of the HA respectively, were also selected for epitope analysis. An antigen residue was defined as an epitope residue if it had a non-zero BSA in the crystal structure. The fraction of glycan surface area in an epitope was calculated as the buried surface area of epitope glycans divided by the buried surface area of the full epitope. Mann-Whitney test was used to quantify the statistical difference between glycan fraction or average residue entropy for HIV-1 vs. influenza or RSV antibody epitopes.

Figures. Structure figures were prepared using PYMOL (The PyMOL Molecular Graphics System, DeLano Scientific, San Carlos, Calif., 2002).

Interfaces. Interactive surfaces were obtained from PISA (ebi.ac.uk/pdbe/pisa/).

Example 2

Crystal Structure of Unliganded HIV-1 Env Trimer in the Prefusion Mature Closed Conformation and Stabilization of the HIV-1 Env Ectodomain in a Prefusion Mature Closed Conformation This example illustrates the three dimensional structure of the BG505 SOSIP.664 trimer in the prefusion mature closed conformation when not bound by neutralizing antibody. Additionally, this example illustrates exemplary HIV-1 Env ectodomains stabilized in a prefusion mature closed conformation. The crystal structure of the HIV-1 Env ectodomain in complex with the PGT122 and 35O22 Fabs (i.e., in a prefusion mature closed conformation) or in unliganded (without bound antibody) compared to the structure of HIV-1 Env in the CD4 bound conformation shows dramatic structural rearrangements in both the membrane-proximal and membrane-distal regions, providing guidance for the stabilization of the mature closed conformation of HIV-1 Env.

The structure of the unliganded HIV-1 Env ectodomain trimer is substantially identical to HIV-1 Env in the PGT122/35O22-bound BG505 SOSIP structure (discussed in Example 1) with rmsd of Cα ~1.1 Å. This finding confirms that the HIV-1 Env ectodomain is not significantly distorted by binding to PGT122 and 35O22 antibodies, and therefore, that the structure disclosed in Example 1 provides an accurate view of the HIV-1 Env ectodomain in the prefusion mature closed conformation.

As the sole viral antigen on the HIV-1-virion surface, trimeric Env—and its gp120 and gp41 subunits—have been the focus of extensive vaccine efforts (Rerks-Ngarm et al., *N Engl J Med*, 361, 2209-2220, 2009; Flynn et al., *J Infect Dis*, 191, 654-665, 2005). These have been stymied, however, by unfavorable Env properties including substantial conformational diversity (Kwong et al., *Nature*, 420, 678-682, 2002). While a near-native soluble Env trimer (BG505 SOSIP.664) has been developed, which is preferentially recognized by broadly neutralizing antibodies (Binley et al., *J Virol.*, 74, 627-643, 2000; Sanders et al., *PLoS pathogens* 9, e1003618, 2013; Sanders et al., *J Virol.*, 76, 8875-8889, 2002), this trimer can be triggered by the CD4 receptor to expose epitopes recognized by ineffective antibodies, and a conformationally fixed trimer remains a key goal for vaccine designers. Here the crystal structure at 3.7 Å resolution of the unliganded SOSIP.664 trimer is presented, its structural compatibility with Env-reactive antibodies is characterized, and structure-based design is used to fix its conformation. The unliganded SOSIP.664 trimer assumed a closed structure, highly similar to antibody-bound structures (Example 1; Julien et al., *Science*, 342, 1477-1483, 2013; Lyumkis et al., *Science* 342, 1484-1490, 2013), which epitope analysis revealed to be structurally compatible with broadly neutralizing antibodies, but not ineffective ones. Structural compatibility correlated with binding antigenicity, except for ineffective antibodies directed to CD4-induced epitopes. Structure-based design yielded conformationally fixed variants, including a 201-433 double cysteine (DS) mutant, with improved specificity for broadly neutralizing antibodies. The DS-SOSIP.664 mutant retained nanomolar affinity for CD4, with which it formed a new structural state: a closed trimer bound by a single CD4 without the typical antigenic hallmarks of CD4 induction. This new structural state appeared to be an obligatory intermediate between the unliganded closed state and an activated state recognized by multiple CD4s and co-receptor. Conformational fixation—enabled by antigenicity-guided structural design—can thus be used to delineate mechanistic states and to improve Env-antigenic specificity, with DS-Env trimers fixed in the unliganded closed state defining a new generation of vaccine immunogens.

HIV-1 uses multiple mechanisms to evade the immune system, and these have stymied the development of an effective vaccine. One mechanism—conformational masking (Kwong et al., *Nature*, 420, 678-682, 2002)—hides the vulnerable shape of trimeric Env recognized by broadly neutralizing antibodies via structural rearrangements that expose immunodominant Env epitopes recognized by non- or poorly neutralizing antibodies. A potential solution is to determine the structure of the vulnerable conformation of Env and to use this structural information and protein design to stabilize or fix the vulnerable shape. Definition of the structure of trimeric HIV-1 Env in its vulnerable shape has been accomplished at increasing resolution by crystallography and cryo-electron microscopy (Example 1; Julien et al., *Science,* 342, 1477-1483, 2013; Lyumkis et al., *Science* 342, 1484-1490, 2013; Liu et al., *Nature* 455, 109-113, 2008). These studies have culminated in atomic-level structures of antibody-bound forms of a soluble, near-native trimer mimic, named BG505 SOSIP.664 for HIV-1 strain (BG505, Wu et al., *J Virol.,* 80, 835-844, 2006) and stabilizing mutations (SOSIP.664, Binley et al., *J Virol.,* 74, 627-643, 2000; Sanders et al., *PLoS pathogens* 9, e1003618, 2013; Sanders et al., *J Virol.,* 76, 8875-8889, 2002). Antibodies, however, can influence conformation, and structures of the Env gp120 subunit can differ substantially when unliganded or antibody-bound (FIG. 32A). It was thus sought to determine and to fix the structure of the unliganded HIV-1 Env trimer. A sparse-matrix approach was used to crystallize an endoglycosidase H-treated BG505 SOSIP.664 trimer from a PEG 400-PEG 3,350 precipitant mixture (Majeed et al., *Structure,* 11, 1061-1070, 2003). Diffraction data extended to 3.7-Å resolution, and structure solution and refinement yielded Rwork/Rfree of 26.1%/28.3%.

Overall, despite differences in glycosylation and lattice packing, the structure of the unliganded trimer assumed a closed conformation, which was remarkably similar to antibody-bound trimers (Example 1; Julien et al., *Science,* 342, 1477-1483, 2013; Lyumkis et al., *Science* 342, 1484-1490, 2013), with an overall root-mean-square deviation (RMSD) in Cα positions of less than 1 Å—substantially lower than observed with monomeric gp120 (FIG. 32A). To determine whether the unliganded closed structure was an appropriate vaccine template, structurally specific for effective HIV-1-neutralizing antibodies and incompatible with non- or poorly neutralizing antibodies, it was first sought to categorize antibodies by their functional efficacy (FIG. 32B). Broadly neutralizing antibodies were defined as those of greater than 35% breadth on a diverse panel of 170 isolates, with ineffective antibodies of less than 15% breadth. Antibodies b12, 35O22 and PGT135 were close to the cutoff for the broadly neutralizing category; and while some antibodies such as the V3-directed 447-52D showed clade-specific breadth (447-52D neutralizes over 20% of clade B isolates), 447-52D was nonetheless categorized as ineffective because its overall breadth was only 12%. The unliganded closed structure was analyzed for its structural compatibility with antibody epitopes—most determined structurally in the context of monomeric gp120 or peptide epitope—based on two measures: antibody-volume overlap and epitope RMSD (FIG. 32C). Antibody-volume overlap correlated strongly with neutralization breadth (p=0.0020). Epitope RMSD trended with breadth, but did not achieve statistical significance (FIG. 32D). An antibody structural compatibility score (ASC), which combined both overlap and RMSD, did achieve significance (p=0.0069) (FIG. 32D).

The unliganded closed structure was compatible with the epitopes for all broadly neutralizing epitopes, except those of the membrane-proximal external region, which recognize epitopes downstream of residue 664, and of antibodies b1214 and CH10315, with CH103 exceeding a 2 Å threshold of epitope similarity and with b12 exceeding a volume threshold of 500 Å3 (FIG. 32D, left). In light of the poor RMSD correlation with trimer structure (FIG. 32D), the RMSD threshold was somewhat arbitrary. Nonetheless, the specific incompatibility of these moderately effective CD4-binding site antibodies suggest that movement of residues of the CD4-binding site could occur relative to the unliganded closed trimer and still achieve moderate neutralization breadth; indeed, induced trimer movements have been observed for b12 (which binds poorly to the BG505 SOSIP.664 trimer, Sanders et al., *PLoS pathogens* 9, e1003618, 2013) by electron microscopy (Liu et al., *Nature* 455, 109-113, 2008) and hydrogendeuterium exchange. By contrast, none of the epitopes for non- or poorly-neutralizing antibodies were structurally compatible with the unliganded closed structure (FIG. 32D, right).

These results indicate the unliganded closed trimer to be structurally specific for neutralizing antibodies. Structural specificity as measured by epitope compatibility, however, is only one of the requirements of an appropriate vaccine template: antigenic specificity as measured by binding to broadly neutralizing and not ineffective antibodies is also crucial. The BG505 SOSIP.664 had previously been shown by Moore, Sanders, and colleagues to be antigenically specific for broadly neutralizing antibodies, though binding to poorly neutralizing antibodies directed at the V3 loop was reported (Sanders et al., *PLoS pathogens* 9, e1003618, 2013). Negative selection by ineffective antibodies such as the V3-directed antibody 447-52D17 to remove aberrantly folded molecules was used (FIG. 36). However, even after V3-antibody negative selection, CD4 triggering efficiently exposed V3 epitopes (Mbah et al., *J Virol.,* 75, 7785-7788, 2001) as well as bridging sheet epitopes (Kwong et al., *Nature* 393, 648-659, 1998) recognized by antibodies like 17b (Thali et al., *J Virol.,* 67, 3978-3988, 1993) (FIG. 33A; FIGS. 37-40). Overall, while structural compatibility (and neutralization breadth) generally correlated with antibody binding, in the presence of CD4, this correlation was lost (FIG. 33A; FIG. 37). Notably, CD4 triggered ineffective antibodies so that their average binding was higher than for broadly neutralizing ones (FIG. 33A, right). CD4 triggering makes BG505 SOSIP.664 less desirable as an immunogen: in primates, it would bind CD4 in vivo and would thus be predicted to elicit ineffective antibodies against the highly immunogenic CD4-induced epitopes.

To fix the unliganded closed state and to prevent CD4 triggering, regions of the unliganded closed structure that moved upon CD4 binding were analyzed to identify cavity-filling hydrophobic substitutions, side-chain pairs capable of forming disulfide bonds, and positions where the introduction of a proline would be compatible with only the unliganded closed structure of Env, but not its receptor-bound conformation (FIG. 33B, insets). These substitutions were engineered into BG505 SOSIP.664, co-expressed with furin in a 96-well transfection format (McLellan et al., *Science* 342, 592-598, 2013) and assessed supernatants on an antigenic panel, comprising broadly neutralizing antibodies PGT122 (Walker et al., *Nature* 477, 466-470, 2011) and VRC01 (Wu et al., *Science* 329, 856-861, 2010), quaternary-specific broadly neutralizing antibodies PGT145 (Walker et al., *Nature* 477, 466-470, 2011) and CAP256-VRC26 (Doria-Rose et al., *Nature,* 509, 55-62, 2014), and poorly neutralizing antibodies F105 and 17b, with the latter tested alone and in the presence of CD4. Several different constructs were tested (FIG. 42). Several promising constructs were purified and analyzed for gp120-gp41 cleavage and oligomeric heterogeneity (FIG. 36) and by meso-scale discovery-electrochemiluminescence immunoassay (MSD-ECLIA) for recognition on a more comprehensive panel of HIV-1-reactive antibodies (FIG. 33C and FIG. 37). One cavity-filling alteration, Y191W, retained recognition of broadly neutralizing antibodies, but only moderately reduced the binding of antibody 17b, while two proline substitutions, Q432P and A433P, showed improved antigenic specificity. A 201C-433C double cysteine (DS) mutant showed virtually no antibody 17b recognition, even in the presence of CD4, while retaining strong recognition of antibody PGT145 and increasing the recognition of antibody CAP256-VRC26 (FIG. 33C). While A433P showed better recognition for broadly neutralizing antibodies compared to 201C-433C, the temporal stability of A433P was found to be lower than that of both BG505 SOSIP.664 and 201C-433C, with 201C-433C exhibiting highest temporal stability (FIG. 37). Notably, with the 201C-433C DS variant, structural compatibility (and neutralization breadth) correlated with antibody binding, even in the presence of CD4 (FIG. 33D; FIG. 37). Modeling of the DS substitution indicated a 201C-433C disulfide to be incompatible with the CD4-bound state, where α-carbons (Cα) of residues 201 and 433 are 9.4 Å apart, separated by a strand of the bridging sheet (Kwong et al., *Nature* 393, 648-659, 1998), and the V3 loop is fully exposed (Huang et al. *Science* 310, 1025-1028, 2005) (FIG. 33E). By contrast, the 201C-433C substitutions are expected to form a disulfide in the unliganded closed trimer, and indeed the unliganded BG505 SOSIP.664 201C-433C exhibited a 6.1° C. increase in thermostability (to 73.10° C.) relative to the parent SOSIP.664 (FIG. 33F).

These results indicate the 201C-433C 'DS' variant of BG505 SOSIP.664 (termed "DS-SOSIP.664") is not triggered by CD4. To define the interaction of the DS-SOSIP.664 variant with CD4, surface plasmon resonance (SPR) was used (FIG. 34A). The DS-SOSIP.664 recognized CD4 with a similar on-rate as the parent SOSIP.664, but with ~10-fold faster off-rate, resulting in a ~10-fold reduction in $K_D$ relative to SOSIP.664 (FIG. 34A). To test for CD4 triggering over a longer time scale, both DS-SOSIP.664 and parent SOSIP.664 were incubated for 100 h in the presence of CD4, and SPR readout of 17b and 3074 epitopes was used to assess triggering. With the parent SOSIP.664, CD4 induced a slow transition to a state with bridging sheet formed ($t_{1/2}$ of 3.3±0.7 h for antibody 17b) and V3 loop exposed (t1/2 of 4.2±1.0 h for antibody 307426) (FIG. 34B and FIG. 40). With DS-SOSIP.664, triggering by CD4 of bridging sheet or V3 was not observed over the entire 100 h time course (FIG. 34B). To define the stoichiometry of CD4 interaction, sedimentation equilibrium analytical ultracentrifugation of parent and DS-SOSIP.664 variants in the presence of excess CD4 was used. Molecular weights consistent with the parent SOSIP.664 binding two to three CD4s and the DS-SOSIP.664 variant binding only one CD4 were observed (FIG. 34C and FIG. 41).

DS-SOSIP.664 can thus capture Env in a single CD4-bound state. To obtain structural information on this single CD4 bound state, the hydrogen-deuterium exchange (HDX) of DS-SOSIP.664 with and without CD4 was characterized. Without CD4, the hydrogen-deuterium exchange of DS-SOSIP.664 appeared similar to the exchange of the parent SOSIP.664 (FIG. 34D); with CD4, the gp120 inner domain, the bridging sheet, and gp41 showed little change upon the addition of soluble CD4 (FIG. 34D). The V2, V3 and the stem of V1 showed a response to CD4, consistent with the slightly increase exposure of V3 epitope observed by MSD-ECLIA (FIG. 33D), but this was substantially less than observed for the parent SOSIP.664. The single CD4-bound DS-SOSIP.664 thus differs from previously observed CD4-bound states in that the typical hallmarks of CD4-induction—such as bridging sheet formation and V3 loop exposure—are absent or substantially reduced.

As the single-CD4-bound state could be SOSIP.664 specific, and indeed both SOSIP.664 and DS-SOSIP.664 variant appear to be extraordinarily rigid, DS-stabilized Envs were assessed in other contexts. When DS mutations were placed into functional virus, they ablated entry (FIG. 40). Single molecule fluorescence energy transfer (smFRET) measurements, utilizing donor-acceptors placed in the first and fourth variable Env loops of functional JR-FL viral spikes, revealed DS mutations to reduce transitions from the ground state. DS-viral spikes remained primarily in the closed ground state, even in the presence of dodecameric CD428 (FIG. 34E). Overall, the asymmetric single CD4-bound state—with fast off-rate for CD4—appeared to be an obligatory intermediate between the unliganded state and a more fully CD4-triggered state capable of binding multiple CD4s and co-receptor (FIG. 34F). In this context, it is noted that the high off-rate of CD4 in the single CD4-bound state, coupled with the slow transition to a 3:1 CD4:trimer stoichiometry, provides a kinetic-based molecular mechanism for the ability of primary HIV-1 isolates to resist neutralization by monomeric CD429.

Additional HIV-1 Env ectodomain variants including one or more amino acid substitutions to stabilize the ectodomain in the prefusion mature closed conformation are set forth in Table 13 and described herein, the antigenicity of some of which is presented in FIGS. 42-53. The antigenicity of exemplary protein nanoparticles including a recombinant HIV-1 Env protein is provided in FIG. 43. The antigenicity of exemplary chimeric HIV-1 Env proteins is provided in FIG. 42.

The unliganded Env trimer—fixed in the pre-fusion closed conformation—may be an ideal HIV-1 immunogen. We assessed DS-SOSIP.664 for physical stability to conditions typically encountered during manufacturing and observed increased stability relative to the parent SOSIP.664 to denaturation by temperature, pH or freeze-thaw (FIG. 35A). To see if the 201C-433C substitutions might serve as a general means of reducing CD4-induced transition in other Env antigens, the 201C-433C and SOS mutations were placed into HIV-1 Env expressed on the surface of enzyme-treated pseudovirions (Crooks et al., *J Virol.*, 85, 5825-5839, 2011). These viral spikes were observed to resist CD4 triggering and to retain the antigenic profile of the soluble trimer for broadly neutralizing antibodies in both BG505 and JR-FL Env backgrounds (FIG. 35B). Overall, the results indicate the disulfide-shackled 201C-433C variants of soluble SOSIP.664 and VLP SOS to be highly desirable antigens: conformationally fixed trimers in which neutralizing epitopes are almost exclusively exposed even in the presence of CD4. It is noted that the path to identify the 201C-433C DS substitution involved an information flow from broadly neutralizing antibodies, through structural compatibility and binding antigenicity, to obtain a conformationally fixed immunogen of appropriate antigenicity (FIG. 35C). What was unexpected was the separation of CD4 binding by the 201C-433C DS alteration into two mechanistic steps: the recognition of one CD4 without any of the antigenic hallmarks of CD4 binding such as bridging sheet formation, and the binding of more than one CD4 along with exposure or formation of characteristic CD4-induced epitopes. In addition to improving the antigenic specificity of unliganded HIV-1 Env immunogens, antigenic-guided conformational fixation can thus reveal additional mechanistic steps of the HIV-1 entry pathway.

Methods

BG505 SOSIP.664 expression, purification, and deglycosylation. BG505 SSOIP.664 trimer was produced in HEK 293 GnTI −/− cells via transient transfection of the BG505 SOSIP expressing plasmid with furin and purified as described previously (Sanders et al., *PLoS pathogens* 9, e1003618, 2013; Julien et al., *Science*, 342, 1477-1483, 2013) and in Example 1. Briefly, the BG505 SOSIP.664 expressed supernatant was passed over the 2G12 IgG-conjugated protein A column, washed with phosphate-buffered saline (PBS), and eluted with the elution buffer containing 3M MgCl2, pH 8.5. The eluted protein was then dialyzed against PBS and set for deglycosylation reaction at 37° C. in the reaction buffer containing 1 mM EDTA, 150 mM NaCl, protease inhibitor cocktail (Roche), 17,000 units of Endo H/ml, and 50 mM sodium acetate, pH 5.8. The deglycosylated BG505 SOSIP was further purified with Superdex 200 16/60 (GE Healthcare) column in the buffer containing 5 mM HEPES 7.5, 150 mM NaCl, and 0.02% NaN3. The peak corresponding to trimeric HIV-1 Env was identified, pooled and concentrated to ~10 mg/ml using an Amicon Ultra-15 centrifugal filter (MWCO 50,000, Millipore) and screened for crystallization. For antigenicity and stability analyses, trimers were purified by affinity chromatography over a VRC01 column, purified by gel filtration over a Superdex 200 16/60 (GE Healthcare) column in buffer containing 5 mM HEPES 7.5, 150 mM NaCl and 0.02% NaN3, and finally, passed through a 447-52D column to remove aberrant trimer species (FIG. 36).

Crystallization screening. Deglycosylated BG505 SOSIP.664 was screened for crystallization using 572 conditions from Hampton, Wizard and Precipitant Synergy (Majeed et al., *Structure*, 11, 1061-1070, 2003) screens using a Cartesian Honeybee crystallization robot as described previously (McLellan et al., *Nature*, 480, 336-343, 2011) and a mosquito robot using 0.1 µl of reservoir solution and 0.1 µl of protein solution. Crystals suitable for structural determination were obtained robotically in 26% PEG 400, 3.2% PEG 3350, and 0.1M sodium acetate pH 5.5. Crystals were cryoprotected in a solution containing 30% glycerol, 30% PEG 400, 4% PEG 3350, and 0.1M sodium acetate pH 5.5, and flash-frozen in liquid nitrogen. Data were collected at a wavelength of 1.00 Å at the SER-CAT beamline ID-22 (Advanced Photon Source, Argonne National Laboratory).

X-Ray data collection, structure solution and model building. Diffraction data were processed with the HKL2000 suite (Otwinowski & Minor, *Methods Enzymol.*, 276, 307-326, 1997). The data were corrected for anisotropy using the anisotropy server services.mbi.ucla.edu/anisoscale/with truncations to 3.7 Å, 3.7 Å, 3.3 Å along a, b, and c axes, respectively. Structure solution was obtained with Phaser using 35O22- and PGT122-bound BG505 SOSIP.664 (PDB ID: 4TVP10) as search models. Refinement was carried out with Phenix (Adams et al., *J Synchrotron Radiat.*, 11, 53-55, 2004). Model building was carried out with Coot (Emsley & Cowtan, *Acta crystal. Section D, Biol. Crystal.*, 60, 2126-2132, 2004).

Structural analyses involving residue-specific properties. To estimate the degree of structural flexibility in the unliganded HIV-1 trimer, we determined the average Cα RMSD distance for each residue position in the unliganded trimer structure (FIG. 32A). The average Cα RMSD distance served as a proxy for structural plasticity and was computed between corresponding residues after optimal superimposition onto a set of 91 X-ray structures from the Protein Data Bank (PDB) (Bernstein et al. *J mol. Biol.*, 112, 535-542, 1977). Each domain of the unliganded trimer was considered separately and superimposed onto the set of structures using the program TM-align (Zhang & Skolnick, *Nucleic Acids Res.*, 33, 2302-2309, 2005). To obtain the best possible registry between corresponding residues, structural superimpositions were guided by amino acid sequence alignments when necessary. A total of 54 monomeric structures were used for superimpositions involving the gp120 domain. To generate FIG. 32A (left), five representative gp120 structures were used; unliganded clade A/E HIV-1 gp120 core$_e$(3TGT) (Kwon et al. *PNAS*, 109, 5663-5668, 2012), b12-bound gp120 (2NY7) (Zhou et al., *Nature* 445, 732-737, 2007), b13-bound gp120 (3IDX) (Chen et al., *Science*, 326, 1123-1127, 2009), F105-bound gp120 (3HI1) 38, and CD4- and 48d-bound gp120 (3JWD) (Pancera et al. PNAS, 107, 1166-1171, 2010) structures. For the gp41 domain a total of 37 structures from the PDB that included hexameric bundles as well as disordered peptides were used.

Hydrogen/deuterium exchange (HDX) mass spectrometry (MS) is indicative of intrinsic amide exchange of peptide segments and is a useful technique to monitor dynamic characteristics of proteins in solution. Qualitative exchange profiles for observable peptides of SOSIP.664 after 3s were extracted from individual HDX-MS exchange plots (Guttman et al., *Structure*, 22, 974-984, 2014). The average exchange values (0-75%) were substituted in the B-factor field for the observed peptides of SOSIP.664 coordinates and displayed within PyMol. Non-observable peptides in the deuterium exchange experiment as well as peptides with missing electron density were excluded from the analysis.

Residue sequence variability was computed as the Shannon entropy for each residue position based on a representative set of 3,943 HIV-1 strains. The electrostatic potential surfaces were generated using GRASP41.

Assessment of antibody functionality on a panel of 170 diverse HIV-1. Neutralization was measured using single-round-of-infection HIV-1 Env-pseudoviruses and TZM-bl target cells, as described previously (Sarzotti-Kelsoe et al., *J. Immunol. Meth.*, 409, 131-146, 2014). Neutralization curves were fit by nonlinear regression using a 5-parameter hill slope equation. The 50% and 80% inhibitory concentrations ($IC_{50}$ and $IC_{80}$) were reported as the antibody concentrations required to inhibit infection by 50% and 80% respectively.

Computation of antibody epitope RMSD, volume overlap, and epitope presence. HIV-1-specific antibody-antigen complex structures were compiled from the PDB, and antibodies were defined as broadly or poorly/non-neutralizing based on published or in-house neutralization data of diverse viral strains (Georgiev et al., *Science*, 340, 751-756, 2013). Antibodies that were deemed to have insufficient evidence for being classified as broadly or poorly/non-neutralizing were excluded from the analysis. A single antibody representative was included in the analysis in cases where multiple antibody clonal relatives were found. The epitope residues for each antibody were defined based on the respective antibody-antigen complex crystal structures, with an antigen residue being defined as an epitope residue if any of its heavy atoms were within 5.5 Å of any antibody heavy atom. To compute the RMSD between the epitope residues in the antibody-antigen complex structure and the same residues in the unliganded trimer structure: (1) the epitope residues from the complex structure were aligned to the unliganded trimer structure using the align function in PyMOL, then (2) the Cα RMSD of the epitope residues was calculated. To remove outlier residues, the top and bottom 10% of the Cα deviations were removed from the RMSD calculation. To calculate the volume overlap between a given antibody and the unliganded trimer structure, the alignment from above was used to compute the overlap volume between the antibody from the complex structure and the unliganded trimer structure by using the phase_vol-Calc utility from Schrödinger. An antibody epitope was considered as present in the unliganded trimer structure if at least 70% of the epitope residues as defined by the antibody antigen complex structure were also present in the unliganded trimer structure. For mapping the per-residue RMSD computation onto the unliganded trimer structure, residues part of any antibody epitope (including epitopes with less than 70% total residues present) were included in the analysis; if a given residue was part of more than one antibody epitope, the highest RMSD value for that residue among all epitopes was used. Antibody volume overlap values were mapped onto the unliganded trimer structure for all residues part of the epitope for the given antibody; if a residue was part of more than one antibody epitope, then the lowest volume overlap for that residue among all epitopes was used. Correlations of structural properties with neutralization and/or binding data were computed using the Spearman correlation coefficient.

Structural compatibility analysis. For a given antibody, the Antigenic Structural Compatibility (ASC) score with the HIV-1 Env unliganded pre-fusion trimer structure was computed based on a comparison to a structure of the antibody bound to an Env-derived antigen (e.g., gp120 core or V3 peptide). ASC scores were computed on a 0-1 scale using the following variables: (i) The fraction f of epitope residues (as defined by the structure of the antibody complex) exposed to solvent in the unliganded trimer structure was computed, with a residue considered accessible to solvent if its solvent-accessible surface area (SASA) was at least half its SASA in the respective antibody complex structure; f was set to 0 if less than 70% of epitope residues were present in the antigen. (ii) A resolution estimate r was used such that Cα RMSDs d below r=2 were not penalized in the scores. (iii) The volume overlap values were used to define a volume overlap factor v that is equal to 1 for overlap below 200 Å3, is equal to 0 for overlap over 1000 Å3, and decays linearly in between. Intuitively, the unliganded trimer structure is expected to be structurally compatible with an antibody if f and v are high and if the RMSD d is low, since such conditions would indicate similarity between the unliganded trimer structure and the Env conformation in the antibody complex. Thus, the ASC score for each antibody with the unliganded trimer was defined by the formula: $fv \exp(-0.5 \max(0, d-r))$.

Transient transfection expression of immunogens in 96-well microplates. A 96-well microplate-formatted transient transfection expression approach was used to achieve high-throughput expression of various immunogen proteins as follows. HEK GnTi-cells were thawed and incubated with growth medium (293 FreeStyle Expression Medium supplemented with 10% Fetal Bovine Serum and 1% streptomycin-penicillin) (Invitrogen, CA) at 37° C., 5% CO2, until the cells reached logarithmic physiological growth. 24 hours prior to DNA-transient transfection, 100 μl of physiologically growing cells was seeded in each well of a 96-well microplate at a density of 2.5×105 cells/ml in expression medium (293 FreeStyle Expression Medium supplemented with 10% Ultra-Low IgG Fetal Bovine Serum and 1×-Non-Essential Amino Acids) (Invitrogen, CA), and incubated at 37° C., 5% CO2 for 20 h. Two hours prior to transfection, 100 μl of spent medium from each well was replaced with 60 μl of fresh expression medium. DNA-TrueFect-Max complexes were used for transfection, and these were prepared by mixing 0.2 μg plasmid DNA in 10 μl of Opti-MEM transfection medium (Invitrogen, CA) with 0.4 μl of TrueFect-Max (United BioSystems, MD) in 10 μl of Opti-MEM, and incubating for 15 min prior to transfection. 20 μl of the complex was added into each well and mixed with growing cells, and the 96-well plate was incubated at 37° C., 5% CO2. One day post transfection, 20 μl of enriched medium (293 FreeStyle Expression Medium supplemented 25% Ultra-Low IgG Fetal Bovine Serum, 2× Non-Essential Amino Acids and 2× glutamine) was added to each well, and returned to incubator for continuous culture. On days three to five post transfection, the culture was exposed to oxygen in the sterilized air once per day. After day five post transfection, the biological function of the expressed protein in the supernatant in 96-well microplate was analyzed using an ELISA assay.

Antigenic analysis of stabilized HIV-1 Env trimeric immunogens in 96-well microplate by antibody binding ELISA assay. The D7324 antibody-coated 96-well ELISA plate was prepared by incubating 2 μg/ml of D7324 Antibody (Aalto, Ireland) in 100 μl PBS in 96 Well Flat-Bottom Immuno Plate (nunc, Thermo, IL) overnight at 4° C., followed by removal of coating solution and incubation of 200 μl/well, 2% (W/V) dry milk in PBS overnight at 4° C., and then the wells were washed 5 times with PBS+0.05% Tween 20. 30 μl of supernatant expressed in each well of the 96-well microplate was incubated with 70 μl of PBS in each well of a D7324 antibody-coated 96-well ELISA plate for two hours at room temperature (RT), and then the wells were washed 5 times with PBS+0.05% Tween 20. 100 μl of anti-specific epitope primary antibody (prepared in our lab) at a concentration of 10 μg/ml in PBS with 0.2% (W/V) dry milk and 0.2% Tween 20 was incubated into each well for 1 hour at RT, and then the wells were washed 5 times with PBS+0.05% Tween 20. 100 μl of Horseradish peroxidase (HRP)-conjugated goat anti-human IgG antibody (Jackson ImmunoResearch Laboratories Inc., PA) at 1:10,000 in PBS with 1.0% (W/V) dry milk and 0.2% Tween 20 was incubated into each well for 30 min at RT, and then the wells were washed 5 times in PBS+0.05% Tween 20. The wells were developed using TMB at RT for 10 min, and the reaction was stopped with 180 mM HCl. The readout was measured at a wavelength of 450 nm. All samples were performed in duplicate.

Antigenic analysis of BG505 SOSIP.664 and mutants by MSD-ECLIA assay using D7324 detection. Standard 96-well bare MULTI-ARRAY Meso Scale Discovery (MSD) Plates (MSD, cat #L15XA-3) were coated with a panel of HIV neutralizing and non-neutralizing monoclonal antibodies in duplicates (30 μL/well) at a concentration of 10 μg/mL, diluted in 1×PBS and the plates were incubated overnight at 4° C. The following day, plates were washed (wash buffer: 0.05% Tween-20+1×PBS) and blocked with 150 μL of blocking buffer [5% [W/V] MSD Blocker A (MSD, Cat # R93BA-4)] and incubated for 1 hr on a vibrational shaker (Heidolph TITRAMAX 100; CAT # P/N: 544-11200-00) at 650 rpm. All the incubations were performed at room temperature, except the coating step. During the incubation, BG505 SOSIP trimer was titrated down in a serial 2 fold dilutions starting at 4 μg/mL concentration of the trimer in assay diluent (1% [W/V] MSD blocker A+0.05% Tween-20). After the incubation with blocking buffer was complete, the plates were washed and the diluted trimer was transferred (25 l/well) to the MSD plates and incubated for 2 hrs on the vibrational shaker at 650 rpm. For soluble CD4 (sCD4) induction, trimer was pre-incubated with sCD4 at a constant molar concentration of 1 μM for 1 hour before adding to the MSD plate. After the 2 hr incubation with trimer, the plates were washed again and secondary detection MSD Sulfotag labeled D7324 antibody (Prior to running the assay D7324 antibody was labeled with MSD Sulfotag (MSD; Cat #R91AN-1) at a conjugation ratio of 1:15 [D7324: Sulfotag]), which was diluted in assay diluent at 5 µg/mL and was added to the plates (25 µL/well) and incubated for 1 hr on the vibrational shaker at 650 rpm. The plates were washed and read using the 1× read buffer (MSD Read Buffer T (4×); Cat# R92TC-2) on MSD Sector Imager 2400.

Antigenic analysis of stabilized HIV-1 Env trimeric immunogens by antibody binding ELISA assay. Similar to what was done for the 96 well plate ELISA, the D7324 (Aalto, Ireland) antibody was coated overnight at 2 µg/ml in 100 µl PBS at 4° C. Wells were washed once in PBS/Tween 20 (0.2%) and blocked with 200 µl/well of 2% (W/V) dry milk in PBS for one hour at room temperature (RT). The wells were then washed 5 times in PBS+0.05% Tween 20 (PBST) and purified proteins (BG505 SOSIP.664 and mutants) were then coated at either 0.5 or 2 µg/ml in PBS, 10% FBS for 2 hours at RT. The wells were washed 5 times in PBS-T. 100 µl of primary antibody at a concentration of 10 µg/ml in PBS/Tween 20 (0.2%) was incubated into each well for 1 hour at RT, and then the wells were washed 5 times in PBS-T. 100 µl of Horseradish peroxidase (HRP)-conjugated goat anti-human IgG antibody (Santa Cruz Biotechnology) at 1:5,000 in PBS with 0.2% Tween 20 was added to each well for 1 hour at RT. The wells were washed 5 times in PBS-T. The wells were developed using Sureblue (KPL) at RT for 10 min, and the reaction was stopped with 180 mM HCl. The readout was measured at a wavelength of 450 nm. All samples were performed in duplicate.

Surface plasmon resonance analysis. Affinities and kinetics of binding to BG505 SOSIP.664 soluble trimer and its mutants were assessed by surface plasmon resonance on a Biacore T-200 (GE Healthcare) at 20° C. with buffer HBS-EP+(10 mM HEPES, pH 7.4, 150 mM NaCl, 3 mM EDTA, and 0.05% surfactant P-20).

For assessing binding of trimer to CD4i antibody 17b and HR2-reactive peptide C34, mouse anti-human Fc antibody was first immobilized onto two flow cells on a CM5 chip at ~10,000 response units (RU) with standard amine coupling protocol (GE Healthcare). Either 17b IgG or C34-Ig was then captured on one flow cell by flowing over a 200 nM solution at 5 µl/min flow rate for two minutes. The other flow cell was used as reference. To block unliganded mouse anti-human Fc antibody, this was followed by a 1-minute injection of 1 µM human Fc on both flow cells. 500 nM unliganded trimer (−CD4) or a complex of 500 nM trimer+ 1500 nM sCD4 (+CD4) was flowed over the sample flow at a flow rate of 50 µl/min for 2 minutes and allowed to dissociate for 5 minutes. The cells were regenerated with two 10 µl injections of 3.0 M MgCl2, pH 7.5 at a flow rate of 100 µl/min. Blank sensorgrams were obtained by injection of the same volume of HBS-EP+ buffer. Sensorgrams were corrected with corresponding blank curves.

For assessing binding of trimer to sCD4, single-cycle kinetics analyses were carried out. First, ~2000RU of antibody 2G12 were immobilized on two flow cells. Next, 200 nM of trimer was injected on the sample flow cell. Finally, 5 concentrations of sCD4 (100 nM, 50 nM, 25 nM, 12.5 nM, 6.25 nM) were injected incrementally in a single cycle, starting from the lowest concentration, followed by a dissociation phase of 30 min. Blank sensorgrams were obtained by injection of same volume of HBS-EP+ buffer in place of sCD4. Sensorgrams of the concentration series were corrected with corresponding blank curves and fitted globally with Biacore T200 evaluation software using a 1:1 Langmuir model of binding.

For assessing affinity and kinetics of antibody 17b binding, trimer was captured onto a 2G12 surface that was obtained by capturing 2G12 IgG on a flow cell immobilized with ~10,000 response units (RU) of mouse anti-human Fc antibody. To block unliganded mouse anti-human Fc antibody, this was followed by a 1-minute injection of 1 µM human Fc on both flow cells. Binding to 17b Fab was carried out in the single-cycle kinetics format with successive injections of 5 concentrations of 17b Fab. Blank sensorgrams were obtained by injection of the same volume of HBS-EP+ buffer in place of antibody Fab fragments. Sensorgrams of the concentration series were corrected with corresponding blank curves and fitted globally with Biacore T200 evaluation software using a 1:1 Langmuir model of binding.

For determining the time-course of CD4 activation of the soluble trimers, 17b IgG, 3074 IgG and 2G12 IgG were captured on three separate flow cells of a CM5 chip immobilized with ~10,000 RU of mouse anti-human Fc antibody. Trimers were incubated in 4-fold molar excess of sCD4 and samples were injected at different time-points. Blank sensorgrams were obtained by injection of same volume of HBS-EP+ buffer in place of trimer. To measure any change in the trimer samples on incubation, unliganded trimers were injected before and 72 hours after start of the experiment.

Biolayer interferometry analysis. A fortéBio HTX instrument was used to measure affinities of BG505 SOSIP.664 and the 201C-430C variant to a panel of HIV-1 Env reactive antibodies at 30° C. All assays were carried out with agitation set to 1,000 rpm in PBS supplemented with 1% BSA (PBS/1% BSA) using solid black 96-well plates (Geiger Bio-One). For the quaternary-specific antibodies CAP256-VRC26.09 and PGT145, the IgG (40 µg/ml) was directly immobilized onto an anti-human capture sensor for 300 s. Typical capture levels were between 1.2 and 1.4 nm, and variability within a row of eight tips did not exceed 0.1 nm. Biosensor tips were then equilibrated for 300 s in PBS/1% BSA buffer prior to assessment of binding to the HIV-1 trimer molecules in solution (0.015 to 0.5 µM). Association was allowed to proceed for 300 s followed by dissociation for 300 s. Dissociation wells were used only once to prevent contamination. Parallel correction to subtract systematic baseline drift was carried out by subtracting the measurements recorded for a sensor loaded with the respiratory syncytial virus (RSV)-specific antibody D25 incubated in PBS/1% BSA.

For all other binding studies, 2G12 (60 µg/ml) was immobilized onto an anti-human capture sensor for 300 s (typical loading levels 1.0 nm) followed by incubation with either the BG505.SOSIP or the 201C-433C variant for 600 s (resulting in loading levels of ~0.8 nm). The 2G12: HIV-1 Env complex was then allowed to associate with Fab molecules (2.5 µM-0.2 µM) in PBS/1% BSA for 300s followed by dissociation for 300-1800 s. A D25:RSV fusion glycoprotein complex was used to control for non-specific binding of the Fab molecules. Data analysis and curve fitting were carried out using Octet software, version 8.1. Experimental data were fitted with the binding equations describing a 1:1 interaction. Global analyses of the complete data sets assuming binding was reversible (full dissociation) were carried out using nonlinear least-squares fitting allowing a single set of binding parameters to be obtained simultaneously for all concentrations used in each experiment.

Negative-stain electron microscopy. Negative-stain electron microscopy samples were diluted to about 0.03 mg/ml, adsorbed to a freshly glow-discharged carbon-film grid for 15s, and stained with 0.7% uranyl formate. Images were collected semi-automatically using SerialEM44 on a FEI Tecnai T20 with a 2k×2k Eagle CCD camera at a pixel size of 0.22 nm/px. Particles were picked automatically and reference-free 2D classification was performed in EMAN245.

Differential scanning calorimetry. The heat capacity of BG505 SOSIP.664 and BG505 SOSIP.664.201C-433C was measured as a function of temperature using a high-precision differential scanning VP-DSC microcalorimeter (GE Healthcare/Microcal, Northampton, Mass.). The samples were extensively dialyzed against PBS, pH 7.4, and then degassed to avoid the formation of bubbles in the calorimetric cells. Thermal denaturation scans were conducted from 10 to 100° C. at a rate of 1° C./min. The protein concentration was about 0.3 mg/mL.

Analytical ultracentrifugation equilibrium measurements. Analytical ultracentrifugation (AUC) equilibrium experiments were performed at 15° C., using a Beckman XL-A/I ultracentrifuge equipped with a Ti60An rotor. Data was collected using UV absorbance at 230 nm. Samples were dialyzed in Na2HPO4 10 mM, NaCl 140 mM, pH 7.4 overnight at 4° C. and loaded into six-channel equilibrium cells with parallel sides and quartz windows. 120 µL aliquots of sample diluted to 0.25 (78), 0.16 (51) and 0.087 (27) µM (µg/mL) were loaded, respectively, into three channels A, B and C of the cell, with three of the channels used for buffer reference. Samples were spun at 5000 rpm (9810*g) for 20 hours, after which four scans were collected at a rate of 1 per hour. The rotor speed was then increased to 6500 rpm (12750*g) for 10 hours, after which four additional scans were collected at the same rate. The speed was further increased to 8000 rpm (15690*g) for another 10 hours and four more scans were recorded under the same conditions. During the last step, the rotor speed was increased to 10000 rpm (19620*g) for four more scans, resulting in a total of 16 scans for each concentration and a total of 48 scans per protein. The data was processed and analyzed using HeteroAnalysis 1.1.44 software (biotech.uconn.edu/auf) and SEDPHAT46. Buffer density and protein v-bars were calculated using the SednTerp (Alliance Protein Laboratories) software. The data for all concentrations and speeds were globally fit using nonlinear regression to an ideal monomer model.

Hydrogen Deuterium Exchange (HDX). The hydrogen-deuterium exchange rates for BG505 SOSIP.664 and the DS-SOSIP.664 both alone and in the presence of CD4 were assessed. Complexes with soluble CD4 (D1D2) were formed by overnight incubation with a nine-fold molar excess of ligand (relative to trimer). Proteins (10 µg) were diluted 10-fold into deuterated PBS buffer and incubated at room temperature. Aliquots removed after 3 s, 1 min, 30 min and 20 h were quenched by mixing with an equal volume of cold 200 mM Tris-2-carboxyethyl phosphine (TCEP), 0.2% formic acid (final pH 2.5). The samples were subsequently digested with pepsin (at 0.15 mg/mL) for 5 min on ice, flash frozen in liquid nitrogen, and stored at −80° C. For LC-MS analysis, samples were thawed on ice for 5 minutes and manually injected onto a Waters BEH 1.7 gm 1.2×5 mm trap column (Waters) flowing 0.1% TFA at 200 µL/min. After 3 minutes of washing the peptides were resolved over a Hypersil 1×50 mm 2.1 µm C18 column (Thermo Scientific) using a gradient of 15 to 40% B in 8 minutes (A: 0.05% TFA 5% ACN; B: 0.05% TFA 80% ACN). Eluted peptides were analyzed with a Waters Synapt Q-TOF mass spectrometer. Peptide identification and exchange analysis were as described previously (Guttman et al., *Structure*, 22, 974-984, 2014).

Neutralization of viral entry. The point mutations were introduced into full-length Env clone BG505.W6M.C212 in expression vector pcDNA3.1/V5-His-TOPO (Invitrogen). Pseudotyped, single round of entry virus was produced as described in Shu et al. (Shu et al., *Vaccine*, 25, 1398-1408, 2007). Briefly, plasmid DNA was used to transfect 293T cells along with an envelope-deficient HIV-1 subtype A proviral plasmid, SG3dEnv48 to generate pseudotyped viral particles. Serial dilutions of the pseudovirus stocks were added to TZMbl reporter cells, and two days later the activity of the luciferase reporter gene in infected cells was assessed with a Luciferase Assay kit (Promega) and measured in a luminometer; activity was reported as Relative Light Units (RLU).

smFRET on JR-FL viral spikes. Briefly, HEK293 cells were transfected at a 40:1 ratio of wild-type HIV-1JR-FL or HIV-1JR-FL 201C-433C Env to dually V1-Q3/V4-A1 tagged Env and the additional presence of pNL4-3 Δenv ART. Virus was concentrated from supernatants 40 h post-transfection and dually labelled overnight in a reaction with 0.5 µM Cy3B(3S)-cadaverine, 0.5 µM Cy5(4S)COT-CoA, 0.65 µM transglutaminase (Sigma), and 5 µM AcpS at room temperature. After addition of DSPE-PEG2,000-biotin (Avanti) at 0.02 mg/ml (30 min), the viruses were purified on a 6-18% Optiprep gradient in 50 mM Tris pH 7.4, 100 mM NaCl and stored at −80° C. For smFRET imaging, viruses were immobilized on streptavidincoated quartz microfluidic devices and imaged at room temperature on a wide-field prism-based TIRF instrument equipped with an Opus 532 nm laser (Laser Quantum). Donor and acceptor fluorescence were collected through a 1.27-NA 60× water-immersion objective (Nikon), and recorded using an ORCA-Flash4.0 sCMOS camera (Hamamatsu) at 25 frames/s for 80 s. All smFRET imaging experiments were performed in buffer containing 50 mM Tris pH7.5, 100 mM NaCl, and a cocktail of triplet-state quenchers and oxygen scavengers. The conformational effects of dodecameric sCD4D1D2 (sCD4D1D2-Igαtp) on wild-type and HIV-1JR-FL 201C-433C mutant Env were tested after incubation with the ligand for 30 min at 0.01 mg/ml. Histograms were fitted into three-state Gaussian curves; and occupancies of each FRET state were calculated from histogram fitting. Following Hidden Markov Modeling, all transitions were displayed in transition density plots (TDP).

Assessment of physical stability. To assess the physical stability of the closed, prefusion conformation of trimeric BG505 SOSIP and 201C-433C proteins, the proteins were subjected to a variety of pharmaceutically relevant stresses such as extreme pH, high temperature, low and high osmolarity, as well as repeated freeze/thaw cycles. The physical stability of treated BG505 SOSIP and 201C-433C proteins was evaluated by measuring the retention of binding to the quaternary-specific V1V2-directed antibodies CAP256-VRC26.09 and PGT145 and induction of binding to the V3-loop antibody 447.52D and the CD4i antibody 17b which is not observed in the closed prefusion conformation of the SOSIP trimer. The retention of binding to CD4-Ig and VRC01 was also measured. In the pH treatment experiments, HIV-1 proteins were prepared at an initial concentration of 125 µg/ml, and pH was adjusted using either pH 3.5 or pH 10 with 0.5 M citrate, pH 2.8 or 1 M CAPS, pH 10.5 buffer respectively and incubated at room temperature for 60 minutes before returning the pH to pH 7.5 using 1 M Tris, pH 8.5 or 1 M Tris, pH 7.0, respectively. In the temperature treatment experiments, HIV-1 proteins at 125 µg/ml concentration were incubated at 50° C., 70° C. and 90° C. for 60 minutes in PCR cyclers with heated lids to prevent evaporation and ramp rates of 2.5° C./s. To assess antigenic characteristics following extremes of low and high osmolarity, spin desalting columns (Thermo Scientific) were used to buffer exchange the proteins into either 5 mM Tris, pH 7.5, 10 mM NaCl or 3 M MgCl2, pH 7.5. Proteins were incubated at room temperature for 60 minutes before buffer exchange into 1×PBS, pH 7.4 and concentrating the sample to 125 µg/ml concentration. The freeze/thaw treatment was carried out by repeatedly flash freezing protein in liquid nitrogen and thawing at 37° C. ten times. All protein solutions were supplemented with 0.2% BSA for a final HIV-1 protein concentration of 100 µg/ml and antibody binding measurements were carried out using a fortéBio Octet HTX instrument. Assays were performed at 30° C. with agitation set to 1000 rpm in tilted black 384-well plates (Geiger Bio-One) and a volume of 50 µl/well. Anti-human Fc probes were loaded with full-length IgG of the antibodies mentioned above at 50 µg/ml in PBS buffer for 180 seconds, which were then equilibrated for 240 seconds in PBS+0.2% BSA before being used to immobilize treated or untreated BG505 SOSIP and 201C-433C proteins for 300 seconds. Parallel measurements of antibody binding to PBS+0.2% BSA and soluble recombinant Influenza hemagglutinin in PBS+0.2% BSA were used to assess systematic baseline drift and non-specific binding. The fractional degree of retention of quaternary structure integrity is reported as the ratio of steady state binding level before and after stress treatment. To assess the physical stability of the closed, prefusion conformation of trimeric BG505 SOSIP, A433P and 201C-433C proteins over time, we incubated a 40 nM solution of each trimer in HBS-EP+ buffer at 4 different temperatures—4° C., 20° C., 37° C. and 42° C. Aliquots were taken at different time points over the course of 10 days, and retention of quaternary structure in the trimers was assessed by SPR by flowing over antibody VRC26.09 captured on an Fc surface. A parallel lane with 2G12 captured on it served as control for equal protein loading. Blank subtractions were carried out as described in the SPR section above. The fractional degree of retention of quaternary structure integrity is reported as the ratio of steady state binding level before and after incubation.

Virus-Like Particles ELISAs. ELISAs were performed as described previously49. Briefly, Immulon II plates were coated overnight at 4° C. with VLPs at 20 times their concentration in transfection supernatants. Wells were washed with PBS and then blocked with 4% bovine serum albumin/10% fetal bovine serum in PBS. Various biotinylated monoclonal antibodies (biotinylated using sulfo-NHSXbiotin, Thermo), and CD4-IgG2 were then titrated in the presence or absence of a fixed concentration of 2 µg/ml soluble CD4. Alkaline phosphatase conjugated to streptavidin (Vector Laboratories, Burlingame, Calif.; to detect biotinylated mAbs) or anti-Fc (Accurate, Westbury, N.Y.; to detect CD4-IgG2) and SigmaFAST p-nitrophenyl phosphate tablets (Sigma) were then used to detect binding. Plates were read at 405 nm.

Figures. Structure figures were prepared using PYMOL50.

Coordinates. The atomic coordinates of an asymmetric unit of the crystal structure of the unliganded trimeric HIV-1 Env ectodomain in the prefusion mature closed conformation are recited in Table 3 submitted as an ASCII text named "Table_3.txt" (~0.7 MB, created on Aug. 7, 2014) in U.S. Provisional Application No. 62/046,059, filed Sep. 4, 2014, and have been deposited with the Protein Data Bank as Acc. No. 47MJ. The atomic coordinates of the crystal structure of an unliganded trimeric HIV-1 Env ectodomain in the pre-fusion mature closed conformation are recited in Table 4 submitted as an ASCII text named "Table_4.txt" (~2 MB, created on Aug. 7, 2014) in U.S. Provisional Application No. 62/046,059, filed Sep. 4, 2014.

Example 3

Production of HIV-1 Env Protein Covalently Linked to Antibody

This example provides an exemplary protocol for producing a recombinant HIV-1 Env protein covalently linked to a broadly neutralizing antibody.

HIV-1 Env expression construct were designed to contain a cysteine mutation at a key complementary site at the antibody complex interface and a protease cleavable Streptactin II tag C-terminal of the HIV-1 Env residue 664. The respective antibodies were mutated to contain a cysteine at a key complementary site at the antibody complex interface and the antibody heavy chain had a C-terminal cleavable His6 tag after the Fab region. In the case of covalently linking VRC01 to HIV-1 gp140 trimer, mutations 459C in HIV-1 Env and 60C in VRC01 heavy chain enabled covalent assembly of the complex within the producer cells.

DNA for the HIV-1 Env, antibody heavy, antibody light and furin were mixed together in a molar ratio of approximately 1:0.25:0.25:0.5 and transfected into suspension HEK 293F cells. 7 days post transfection the supernatants were harvested, clarified and filtered. The media was passed through NiNTA resin and after washing with PBS eluted in 250 mM imidazole. The eluate was passed over a 2 ml streptactin column, washed with 5 ml wash buffer and eluted in 3 ml elution buffer using the manufacturer's buffer formulations. The resulting eluate was concentrated to 1.5 ml and passed through a Superdex S200 gel filtration column equilibrated in phosphate buffered saline and the main peak containing the covalently linked complex was verified to contain the intermolecular disulfide bond by reducing and non-reducing SDS-PAGE. Fractions corresponding to the covalently linked antibody-Env complex were pooled and flash frozen in liquid nitrogen and stored at −80C.

Example 4

Single Chain HIV-1 Env Proteins

HIV-1-Env constructs from various strains were synthesized and include the "SOS" mutations (A501C, T605C), the isoleucine to proline mutation at residue 559 (I559P), and the glycan site at residue 332 (T332N); mutating the gp120/gp41 cleavage site to a ten-amino-acid linker; and truncating the C terminus to residue 664 (all HIV-1 Env numbering according to the HXB2 nomenclature). This construct in the case of the BG505 strain is referred to as bC10ln.

The bC10ln construct was transfected in HEK 293 F cells using 1 mg plasmid DNA and transfection supernatants were harvested after 7 days, and passed over either a 2G12 antibody- or VRC01 antibody-affinity column. After washing with PBS, bound proteins were eluted with 3M MgCl$_2$, 10 mM Tris pH 8.0. The eluate was concentrated to less than 5 ml using a Centricon-70 and applied to a Superdex 200 column, equilibrated in phosphate buffered saline. The peak corresponding to trimeric HIV-1 Env was identified, pooled, and concentrated or flash-frozen in liquid nitrogen and stored at −80° C.

Constructs such as bC10ln were also designed with a C-terminal Thrombin cleavage site, His$_6$-tag, Streptactin II tag to enable purification as described in McLellan et al. Science 340, 1113-1117, 2013. Briefly, supernatants were harvested after 7 days, and passed over NiNTA affinity column. After washing with PBS, bound proteins were eluted with 250 mM imidazole. The eluate was concentrated to less than 3 ml using a Centricon-70 and applied to a 2 ml Streptactin column, equilibrated in phosphate buffered saline. The sample was eluted in 8 ml of elution buffer. The eluate was concentrated to less than 5 ml using a Centricon-70 and applied to a Superdex 200 column, equilibrated in phosphate buffered saline. The peak corresponding to trimeric HIV-1 Env was identified, pooled, and concentrated or flash-frozen in liquid nitrogen and stored at −80° C.

Example 5

Chimeric HIV-1 Env Proteins

This example describes the design and production of chimeric HIV-1 Env immunogens based on diverse HIV-1 strains. In the context of inducing an immune response in a subject that can control infection across multiple HIV-1 strains, the use of immunogens based on diverse HIV-1 strains can overcome the intrinsic sequence diversity of HIV-1 Env.

The structural data provided in the prior Examples illustrates that the HIV-1 Env ectodomain in the prefusion mature closed conformation includes a "base" or "platform" including three gp41 molecules, each of which wrap their hydrophobic core around the extended N- and C-termini-strands of gp120 (see, e.g., FIGS. 45-46). Accordingly, chimeric HIV-1 Env ectodomains were designed with N- and C-terminal regions of gp120 and the gp41 ectodomain from a first HIV-1 strain, and the remainder of gp120 from a second HIV-1 strain. As illustrated in FIGS. 45-46, these chimeric HIV-1 Env proteins allow for a gp41 "platform" on which a chimeric gp120 sequence can be presented to the immune system. The variable gp120 molecule sits on top of a gp41 from the BG505 strain (with SOSIP substitutions), with the N- and C-terminal regions of gp120 also from the BG505 strain. As shown in red in FIG. 47, the N- and C-terminal regions of gp120 can include all or part of the β-4 strand, the β-3 strand, the β26 strand, the β25 strand and/or the α5 helix.

The interface between the gp41 and gp120 proteins in the HIV-1 Env trimer includes gp120 residues 46-54, 70-75, 84-89, 99, 102, 106, 107, 114, 215, 220-224, 226, 244, 471-473, and 476-477 ("Interface Residue set A"). In FIG. 47, these residues are shaded light blue. Accordingly, additional chimeric HIV-1 Env ectodomains were designed with N- and C-terminal regions of gp120, Interface Residue Set A, and the gp41 ectodomain from a first HIV-1 strain, and the remainder of gp120 from a second HIV-1 strain (these chimeras include reference to "Interface Residue Set A" in columns 6 or 7 of the tables in Table 13). These chimeric HIV-1 Env ectodomains include an expanded "platform" on which a chimeric gp120 sequence can be presented to the immune system.

A chimeric HIV-1-Env construct was synthesized that includes gp120 residues 31-45 and 478-507, and gp41 residues 512-664 from the BG505 strain with SOSIP and 332N substitutions (e.g., as set forth as SEQ ID NO: 3), and the remainder of the gp120 residues (46-477) from the 3301_V1_C24 HIV-1 strain (SEQ ID NO: 751), which is a clade C virus. The protease cleavage site separating gp120/gp41 was mutated to include six arginine residues, and the C-terminus of gp41 was set at position 664 (all HIV-1 Env numbering according to the HXB2 nomenclature). The amino acid sequence of the resulting chimeric Env protein is provided as SEQ ID NO: 384 (3301_V1_C24_bg505-NCgp120+gp41.SOSIP). Additional variants were designed and produced, including a chimeric HIV-1 Env ectodomain trimer having gp41, and gp120 N- and C-terminal region sequences from the BG505 strain (with SOSIP substitutions), with the remaining gp120 sequence from the ZM53, or 25925-2.22 strains. The corresponding chimeric proteins were termed ZM53_BG505-NCgp120_gp41.SOSIP (SEQ ID NO: 386), 25925-2.22_BG505-NCgp120_gp41.SOSIP (SEQ ID NO: 383), and 3301_V1_C24_BG505-NCgp120+gp41.SOSIP (SEQ ID NO: 384). Expression and purification was performed as described in Examples 1 and 2 above.

A further variant was produced, SEQ ID NO: 382 (CNE58_SU-strandC_bg505-NCgp120+gp41.SOSIP) that includes gp41 and gp120 N- and C-terminal regions (31-45 and 478-507, respectively) from BG505.SOSIP.664, with residues 166-173 (V1V2 strand C) from CAP256 SU, and the rest of gp120 from the CNE58 strain.

DNA constructs encoding the chimeric Env proteins were transfected in HEK 293 F cells using 1 mg plasmid DNA and 250 μg plasmid encoding Furin as described previously (Sanders, PLoS pathogens 9, e1003618, 2013, incorporated by reference herein). Transfection supernatants were harvested after 7 days, and constructs that ended at residue 664 were purified using a GNA-Lectin affinity column as described in Pejchal et al., Science, 334: 1097-1103, 2011, incorporated by reference herein. Briefly, supernatants were passed over the GNA-lectin-affinity column and after washing with PBS, bound proteins were eluted with 1 M methyl α-D-mannoside. The eluate was concentrated to less than 5 ml using a Centricon-70 and applied to a Superdex 200 column, equilibrated in phosphate buffered saline. The peak corresponding to trimeric HIV-1 Env was identified, pooled, and concentrated or flash-frozen in liquid nitrogen and stored at −80° C.

Constructs were also designed with a C-terminal Thrombin cleavage site, $His_6$-tag, Streptactin II tag to enable purification as described in McLellan et al. Science 340, 1113-1117, 2013. Briefly, supernatants were harvested after 7 days, and passed over NiNTA affinity column. After washing with PBS, bound proteins were eluted with 250 mM imidazole. The eluate was concentrated to less than 3 ml using a Centricon-70 and applied to a 2 ml Streptactin column, equilibrated in phosphate buffered saline. The sample was eluted in 8 ml of elution buffer. The eluate was concentrated to less than 5 ml using a Centricon-70 and applied to a Superdex 200 column, equilibrated in phosphate buffered saline. The peak corresponding to trimeric HIV-1 Env was identified, pooled, and concentrated or flash-frozen in liquid nitrogen and stored at −80° C.

The 3301_V1_C24_bg505-NCgp120+gp41.SOSIP and ZM53_BG505-NCgp120_gp41.SOSIP chimeras had nearly full gp120/gp41 cleavage, as shown by SDS-page (FIG. 48, left). Further, these chimeras eluted from the purification column in trimeric form under a single peak (FIG. 48, right). The antigenicity of the 3301_V1_C24_bg505-NCgp120+gp41.SOSIP, ZM53_BG505-NCgp120_gp41.SOSIP, 25925-2.22_BG505-NCgp120_gp41.SOSIP, and 3301_V1_C24_BG505-NCgp120+gp41.SOSIP chimeric HIV-1 Env trimers was interrogated using Meso Scale Discovery multi-array electro-chemiluminescence (FIG. 49). As illustrated in FIG. 49, the chimeras specifically bound to quaternary specific antibodies, but not to non- or poorly-neutralizing antibodies.

Additional variants were designed and produced, including a chimeric HIV-1 Env including a BG505 gp120 sequence with SOSIP substitutions, and a CAP45 gp41 sequence. The sequence of this chimera is provided as SEQ ID NO: 772. Structural analysis of the gp120 and gp41 contacts confirm that there is minimal disruption between the gp120-gp41 interface when substituting this strain. The BG505.SOSIP/CAP45 chimera had nearly full gp120/gp41 cleavage, as shown by SDS-page (FIG. 50, left). Further, antigenic analysis by ELISA confirmed that this chimera specifically bound to quaternary specific antibodies, but not to non- or poorly-neutralizing antibodies (FIG. 50, right).

The neutralization profile of several neutralizing and non-neutralizing antibodies was compared with the antigenic profile of a chimeric HIV-1 Env ectodomain based on the native DU156 virus. As shown in FIG. 51, the neutralization profile correlates with the antigenic profile, particularly for the chimeric HIV-1 Env ectodomain including the 201C/433C substitutions.

Many additional chimeric HIV-1 Env ectodomain proteins were designed and produced, including those provided as SEQ ID NOs: 379-386, 579-595, 764-772, 856-1056, 1077-1098, and 1114-1200. The details of the design of each of these chimeric Env proteins are provided in Table 13. Additional recombinant HIV-1 Env ectodomains including stabilizing substitutions and based on more HIV-1 strains were also produced, including those provided as SEQ ID NOs: 1057-1077. The recombinant HIV-1 Env ectodomains were expressed in cells and the corresponding antigenic characteristics of each ectodomain was evaluated by bind antibody binding assay.

Binding to several different antibodies was assayed to evaluate the antigenic profile of each the recombinant HIV-1 Env proteins (FIGS. 44 and 53). The antibodies tested included VRC26 and PGT145 (which bind V1V2 specific epitopes present on the prefusion mature closed conformation of HIV-1 Env), F105 (which binds an epitope that is not present on the prefusion mature closed conformation of HIV-1 Env), 17b (which binds a CD4-induced epitope) in the presence or absence of sCD4, PGT151 and 35O22 (which bind conformational epitopes including gp120 and gp41 residues of HIV-1 Env in its prefusion mature conformation), PGT122 (which binds a conformation epitope including V1V2 and V3-glycan residues), 447-52D (which binds a V3-loop epitope), and VRC01 (which binds the CD4 binding site).

FIG. 53 shows the antigenic readout of many chimeric HIV-1 Env ectodomains, each of which was stabilized in a prefusion mature conformation using the SOSIP substitutions and a 201C-433C disulfide bond. The antigenicity assays show that all of the recombinant HIV-1 Env proteins tested exhibited little to no binding to the 17b antibody, even in the presence of a molar excess of soluble CD4. This finding illustrates the effectiveness of this mutation (201C-433C) for stabilizing the HIV-1 Env ectodomain in a conformation that is resistant to CD4-induced change.

Additionally, bioinformatics algorithms were used to identify chimeric HIV-1 Env ectodomains that exhibited relatively strong binding to quaternary-specific antibodies (e.g., VRC26) and relatively weak binding to weakly neutralizing antibodies (e.g., F105). Based on these algorithms, several chimeras of particular interest were identified, including the following:

DU422.01-chim_d7324.201C-433C (SEQ ID NO: 964)
ZM106.9-chim_d7324.201C-433C (SEQ ID NO: 1025)
CH038.12-chim_d7324.201C-433C (SEQ ID NO: 938)
16055-2.3-chim_d7324.201C-433C (SEQ ID NO: 872)
ZM55.28a-chim_d7324.201C-433C (SEQ ID NO: 1098)
CH117.4-chim_d7324.201C-433C (SEQ ID NO: 940)
ZM53.12-chim_d7324.201C-433C (SEQ ID NO: 1034)
25925-2.22-chim_d7324.201C-433C (SEQ ID NO: 881)
BI369.9A-chim_d7324.201C-433C (SEQ ID NO: 924)
3301.V1.C24-chim_d7324.201C-433C (SEQ ID NO: 888)
CAP45.G3-chim_d7324.201C-433C (SEQ ID NO: 937)
C1080.c3-chim_d7324.201C-433C (SEQ ID NO: 930)
286.36-chim_d7324.201C-433C (SEQ ID NO: 856)
MW965.26-chim_d7324.201C-433C (SEQ ID NO: 978)
CNE55-chim_d7324.201C-433C (SEQ ID NO: 953)
C4118.09-chim_d7324.201C-433C (SEQ ID NO: 933)
DU156.12-chim_d7324.201C-433C (SEQ ID NO: 962)
TH966.8-chim_d7324.201C-433C (SEQ ID NO: 1010)
6545.V4.C1-chim_d7324.201C-433C (SEQ ID NO: 908)
620345.c1-chim_d7324.201C-433C (SEQ ID NO: 902)
0921.V2.C14-chim_d7324.201C-433C (SEQ ID NO: 871)
AC10.29-chim_d7324.201C-433C (SEQ ID NO: 917)
QH209.14M.A2-chim_d7324.201C-433C (SEQ ID NO: 990)
MB201.A1-chim_d7324.201C-433C (SEQ ID NO: 973)

These chimeras include gp120 sequences from several different HIV-1 subtypes, including subtype A (BI369.9A, MB201.A1, QH209.14M.A2), subtype B (AC10.29), subtype C (0921.V2.C14, 16055-2.3, 25925-2.22, 286.36, CAP45.G3, DU156.12, DU422.01, MW965.26, ZM53.12, ZM55.28a, ZM106.9), subtype CRF AC (3301.V1.C24, 6545.V4.C1), subtype CFR AE (620345.c1, C1080.c3, C4118.09, CNE55, TH966.8) and subtype CRF BC (CH038.12, CH117.4). Thus, these results demonstrate that the strategies for stabilizing chimeric HIV-1 Env ectodomains in the prefusion mature closed conformation disclosed herein can be applied across a diverse array of HIV-1 strains.

Based on the antigenic characteristics of the assayed chimeras, additional chimeric HIV-1 Env ectodomains were constructed. By comparing the sequences for assayed chimeras with good antigenic characteristics (e.g., strong binding to VRC26 and low binding to F105) to chimeras with poor antigenic characteristics (e.g., low binding to VRC26 and strong binding to F105), residue positions within gp120 that had different amino acid composition in the former vs. the latter set of chimeras were identified using bioinformatics algorithms. In a non-limiting embodiment, such residue positions included Residue Set B (SEQ 1114-1142): 133-134, 164, 169, 308, and 316 from BG505. In another non-limiting embodiment, such residue positions included the expanded set Residue Set C (SEQ 1143-1171: 49, 133-134, 149-152, 164, 169, 188, 190, 211, 223, 252, 281, 293, 308, 316, 336, 340, 352, 360, 362-363, 369, 372, 393, 410, 432, 442, 444, 446, 474, and 476 from BG505. In another non-limiting embodiment, such residue positions included the expanded set Residue Set C+Residue Set D (SEQ 1172-1200): 46, 60, 62-63, 84-85, 87, 99, 102, 130, 132, 135, 153, 158, 160-161, 165-167, 171-173, 175, 177-178, 181, 184-185, 189, 202, 232, 234, 236, 240, 268-271, 275, 277, 287, 289, 292, 295, 297, 305, 315, 317, 319, 322, 328, 330, 332-335, 337, 339, 343-347, 350-351, 357, 371, 375, 379, 387, 389, 394, 411, 412-413, 415, 424, 426, 429, 440, 460-461, 465, 475, and 477 from BG505.

Example 6

Protein Nanoparticles Including Recombinant HIV-1 Env Proteins

This example provides an exemplary protocol for producing a protein nanoparticle including a recombinant HIV-1 Env protein that is stabilized in a prefusion mature conformation.

BG505 SOSIP.664 linked to nanoparticles (e.g. Ferritin) was cotransfected with furin in HEK 293 S GnTI−/− cells using 500 μgs plasmid DNA and 125 μgs of furin. Transfection supernatants were harvested after 7 days, and passed over either a 2G12 antibody- or VRC01 antibody-affinity column. After washing with PBS, bound proteins were eluted with 3M $MgCl_2$, 10 mM Tris pH 8.0. The eluate was concentrated to less than 5 ml with Centricon-70 and applied to a Superdex 200 column, equilibrated in 5 mM HEPES, pH 7.5, 150 mM NaCl, 0.02% azide. The peak corresponding to the nanoparticle size was identified, pooled, and concentrated or flash-frozen in liquid nitrogen and stored at −80° C.

Alternatively, other methods as described in Kanekiyo et al., Nature, 499, 102-106, 2013, incorporated by reference herein, can be used to purify nanoparticles including recombinant HIV-1 Env proteins.

Example 7

Immunization of Animals

This example describes exemplary procedures for the immunization of animals with the disclosed immunogens, and measurement of the corresponding immune response.

In some examples nucleic acid molecules encoding the disclosed immunogens are cloned into expression vector CMV/R. Expression vectors are then transfected into 293F cells using 293Fectin (Invitrogen, Carlsbad, Calif.). Seven days after transfection, cell culture supernatant is harvested and passed over either a 2G12 antibody- or VRC01 antibody-affinity column. After washing with PBS, bound proteins were eluted with 3M $MgCl_2$, 10 mM Tris pH 8.0. The eluate was concentrated to less than 5 ml with Centricon-70 and applied to a Superdex 200 column, equilibrated in 5 mM HEPES, pH 7.5, 150 mM NaCl, 0.02% azide. The peak corresponding to trimeric HIV-1 Env was identified, pooled, and concentrated or flash-frozen in liquid nitrogen and stored at −80° C. Some proteins are purified using HiTrap IMAC HP Column (GE, Piscataway, N.J.), and subsequent gel-filtration using SUPERDEX™ 200 (GE). In some examples the 6×His tag is cleaved off using 3C protease (Novagen, Madison, Wis.).

For vaccinations with the disclosed immunogens 4-6 months old guinea pigs (Strain Hartley)(Charles River Laboratories, MA) are immunized using polyIC (High molecular weight, InvivoGen Inc, CA) as the adjuvant. Specifically, four guinea pigs in each group are vaccinated with 25 μg of protein and 100 μg of polyIC in 400 μl intramuscularly (both legs, 200 μl each leg) for example at week 0, 4, 8, 12, 22. Sera are collected for example at week 2 (Post-1), 6 (Post-2), 10 (Post-3), 14 (Post-4) and 24 (Post-5), and subsequently analyzed for their neutralization activities against a panel of HIV-1 strains, and the profile of antibodies that mediate the neutralization.

The immunogens are also used to probe for guinea pig anti-sera for existence of HIV-1 neutralizing antibodies in the anti-sera, such as antibodies that compete for binding to the recombinant HIV-1 Env ectodomain trimer with PGT122, PGT145, PGT151, and/or VRC26.

Example 8

Immunization of Non-human Primates

This example describes exemplary procedures for the immunization of non-human primates with the disclosed immunogens, and measurement of the corresponding immune response.

In some examples nucleic acid molecules encoding the disclosed immunogens are cloned into expression vector CMV/R. Expression vectors are then transfected into 293F cells using 293Fectin (Invitrogen, Carlsbad, Calif.). Seven days after transfection, cell culture supernatant is harvested and passed over either a 2G12 antibody- or VRC01 antibody-affinity column. After washing with PBS, bound proteins were eluted with 3M $MgCl_2$, 10 mM Tris pH 8.0. The eluate was concentrated to less than 5 ml with Centricon-70 and applied to a Superdex 200 column, equilibrated in 5 mM HEPES, pH 7.5, 150 mM NaCl, 0.02% azide. The peak corresponding to trimeric HIV-1 Env was identified, pooled, and concentrated or flash-frozen in liquid nitrogen and stored at −80° C. Some proteins are purified using HiTrap IMAC HP Column (GE, Piscataway, N.J.), and subsequent gel-filtration using SUPERDEX™ 200 (GE). In some examples the 6×His tag is cleaved off using 3C protease (Novagen, Madison, Wis.).

For vaccinations with the disclosed immunogens, Indian origin Rhesus Macaque (bodyweights more than 2 kg) are immunized with polyIC-LC as the adjuvant. Specifically, five monkeys in each group are vaccinated with 100 μg of protein and 500 μg polyIC-LC in 1 ml intramuscularly in the Quadriceps muscle for example at week 0, 4, 20. Sera are collected for example at week 2 (Post-1), 6 (Post-2), 24 (Post-3), and subsequently analyzed for their neutralization activities against a panel of HIV-1 strains, and the profile of antibodies that mediate the neutralization.

The immunogens are also used to probe for Rhesus Macaque anti-sera for existence of HIV-1 neutralizing antibodies in the anti-sera, such as antibodies that compete for binding to the recombinant HIV-1 Env ectodomain trimer with PGT122, PGT145, PGT151, and/or VRC26.

Example 9

Assaying Serum Neutralization Activity

Following immunization with a disclosed immunogen (e.g., as described above) serum can be collected at appropriate time points, frozen, and stored for neutralization testing. The serum neutralization activity can be assayed using various assays, such as a pseudoviruses neutralization assay.

In some embodiments, the serum neutralization activity can be assayed essentially as previously described (see, e.g., Georgiev et al., Science, 340, 751-756, 2013, which is incorporated by reference herein in its entirety). Briefly, frozen serum from the immunized subject is heat-inactivated at 56° C. for 30 min prior to the assay. Pseudovirus stocks are prepared by co-transfection of 293T cells with an HIV-1 Env-deficient backbone and an expression plasmid for the Env gene of interest. The serum to be assayed is diluted in Dulbecco's modified Eagle medium-10% FCS (Gibco) and mixed with pseudovirus. After 30 min, 10,000 TZM-bl cells are added, and the plates are incubated for 48 hours. Assays are developed with a luciferase assay system (Promega, Madison, Wis.), and the relative light units (RLU) are read on a luminometer (Perkin-Elmer, Waltham, Mass.). The percent neutralization is calculated as follows: % neutralization=$100\times(V_o-V_n)/V_o$, where $V_n$ is the RLU in the virus and antibody wells and $V_0$ is the RLU in the virus-only wells. The reciprocal dilution at which 50% of the virus is neutralized (ID50) is computed for each virus-serum pair. To account for background, a cutoff of ID50>=40 is used as a criterion for the presence of serum neutralization activity against a given virus.

Standard panels of Env proteins from selected HIV-1 strains have been developed for co-expression with the Env-deficient backbone in the neutralization assay (see, e.g., Georgiev et al., Science, 340, 751-756, 2013, incorporated by reference herein). For example, the standard panel can include Env proteins from HIV-1 strains from Clade A (KER2018.11, Q23.17, Q168.a2, Q769.h5, and RW020.2), Clade B (BaL.01, 6101.10, BG1168.01, CAAN.A2, JR-FL, JR-CSF.JB, PVO.4, THRO4156.18, TRJO4551.58, TRO.11, and YU2), and Clade C (DU156.12, DU422.01, ZA012.29, ZM55.28a, and ZM106.9). An additional standard panel is provided in Table S5 of Georgiev et al. (Science, 340, 751-756, 2013, which is incorporated by reference herein in its entirety) and Table 1 of Seaman et al., J. Virol., 84, 1439-1452, 2005, which is incorporated by reference herein in its entirety).

Example 10

Treatment of Subjects

This example describes methods that can be used to treat a subject that has or is at risk of having an infection from HIV-1 that can be treated by eliciting an immune response, such as a neutralizing antibody response to HIV-1. In particular examples, the method includes screening a subject having, thought to have or at risk of having a HIV-1 infection. Subjects of an unknown infection status can be examined to determine if they have an infection, for example using serological tests, physical examination, enzyme-linked immunosorbent assay (ELISA), radiological screening or other diagnostic technique known to those of skill in the art. In some examples, subjects are screened to identify a HIV-1 infection, with a serological test, or with a nucleic acid probe specific for a HIV-1. Subjects found to (or known to) have a HIV-1 infection can be administered a disclosed immunogen (such as a recombinant HIV-1 Env stabilized in a prefusion mature closed conformation) that can elicit an antibody response to HIV. Subjects may also be selected who are at risk of developing HIV, such as subjects exposed to HIV.

Subjects selected for treatment can be administered a therapeutic amount of a disclosed immunogen as disclosed herein. For example, a disclosed HIV-1 Env protein stabilized in a prefusion mature closed conformation can be administered at doses of 0.5 µg/kg body weight to about 1 mg/kg body weight per dose, such as 1 µg/kg body weight-100 µg/kg body weight per dose, 100 µg/kg body weight-500 µg/kg body weight per dose, or 500 µg/kg body weight-1000 µg/kg body weight per dose. However, the particular dose can be determined by a skilled clinician. The immunogen can be administered in one or several doses, for example in a prime-boost vaccination. The mode of administration can be any used in the art. The amount of agent administered to the subject can be determined by a clinician, and may depend on the particular subject treated. Specific exemplary amounts are provided herein (but the disclosure is not limited to such doses).

Example 11

Inducing a Neutralizing Immune Response in an Animal Model

This example provides data showing that a HIV-1 Env ectodomain trimer stabilized in the prefusion mature conformation can induce a neutralizing immune response in multiple animal models.

Two months old Hartley guinea pigs (four animals per study group) or New Zealand white rabbits (five animals per study group) were immunized at weeks 0, 4, and 16, as follows: Guinea pigs
1) BG505 SOSIP (25 µg) and polyIC (100 µg) as adjuvant
2) BG505 SOSIP DS (25 µg) and polyIC (100 µg) as adjuvant
3) BG505 SOSIP (25 µg) and Matrix M (25 µg) as adjuvant
4) BG505 SOSIP DS (25 µg) and Matrix M (25 µg) as adjuvant Rabbits
1) BG505 SOSIP (30 µg) and Matrix M (30 µg) as adjuvant
2) BG505 SOSIP DS (30 µg) and Matrix M (30 µg) as adjuvant Serum collected from immunized rabbits (FIG. 54A) or guinea pigs (FIG. 54B) was assayed for binding to BG505.SOSIP trimer and a V3 peptide. The immunization groups elicited comparable anti-BG505 trimer or anti-V3 peptide antibodies in rabbits (p<0.05, week 18, Mann Whitney t-test).

Serum collected at weeks 6 and 18 was also tested for neutralization activity against a panel of HIV-1 strains (FIG. 55). Sera from immunized animals were assessed for virus neutralization using a single round infection assay of TZM-bl cells to determine $IC_{50}$ values. As shown in FIG. 55, the BG505 SOSIP DS immunogen elicited an immune response that neutralized both autologous virus (BG505.W6M.C2.T332N) and V3 directed tier 1 virus (MW965.26) infection, as measured by IC value. As expected because rabbits and guinea pigs do not express CD4, the neutralization activity of sera from BG505 SOSIP DS and BG505 SOSIP immunized animals was similar.
Methods Immunogen preparation. HIV-1 Env trimer preparation was performed substantially as described in Example 2. The BG505.SOSIP.664 HIV-1 Env ectodomain trimer (SEQ ID NO: 3) or the BG505.SOSIP.664.201C-433C HIV-1 Env ectodomain trimer (SEQ ID NO: 26) were used. Trimers were purified by affinity chromatography over a VRC01 column, purified by gel filtration over a Superdex 200 16/60 (GE Healthcare) column in buffer containing 5 mM HEPES 7.5, 150 mM NaCl, and 0.02% NaN3, and finally, passed through a 447-52D column to remove aberrant trimer species (as described in Example 2 and illustrated in FIG. 36). The materials used for immunization were tested using Meso-Scale Discovery-Electrochemiluminescence Immunoassay (MSD-ECLIA) Analysis as described in Example 2 to confirm antigenic properties (binding to broadly neutralizing antibodies).

Immunizations. Guinea pig injections consisted of 25 µg of Env trimer formulated in a 400 ul volume in PBS, with 100 µg of PolyIC adjuvant (HMW, Invivogen) or 25 µg Matrix M (Novavax; see Reimer et al., PLoS One, 7(7): e41451, 2012). For rabbit studies, 30 µg of Env trimer was formulated with 30 µg Matrix M in a 1 ml volume in PBS. The immunization was administered intramuscularly as two separate injections into each quadriceps. PolyIC adjuvant was prepared by making a 2 mg/ml stock solution in saline, heating the necessary amount for 10 min at 70° C., and cooling at room temperature for 1 hour prior to injection. Immunizations were performed on weeks 0, 4, and 16. Blood draws for immune assessment included a prebleed −1 week sample, followed by blood draws 2 weeks after each immunization. Collected sera were heat inactivated for 1 hour at 56° C. before being analyzed.

Enzyme-Linked Immunosorbent Assays (ELISAs) for Anti-V3 Peptide Responses. 96 well plates (Reacti-Bind®, Pierce) were coated with 100 µl/well of 2 µg/ml peptide in PBS overnight at 4° C. (MW965.26 V3 peptide: TRPNNNTRKSIRIGPGQTFYATG (residues 265-287 of SEQ ID NO: 2); BG505 V3 peptide: TRPNNNTRKSIRIG-PGQAFYATG (residues 296-318 of SEQ ID NO: 2), amino acid difference underlined). For each consecutive step following coating, plates were washed 5 times with PBS-T (PBS+0.05% tween) and incubated at 37° C. for 1 hour. After coating, plates were blocked with 200 µl/well of blocking buffer (B3T: 150 mM NaCl, 50 mM Tris-HCl, 1 mM EDTA, 3.3% fetal bovine serum, 2% bovine albumin, 0.07% Tween 20, 0.02% thimerosal). Next, guinea pig sera was diluted in B3T and added in 5-fold serial dilutions to the plates. Then goat anti-guinea pig antibody conjugated with horseradish peroxidase (KPL, Gaithersburg, Md.,) at a 1:10,000 dilution in B3T was added to each well. TMB substrate (SureBlue™, KPL, Gaithersburg, Md., cat #52-00-03) was used to develop plates for 10 minutes before 1N sulfuric acid was added to stop the reaction without washing beforehand. Plates were read at 450 nm (Molecular Devices, SpectraMax using SoftMax Pro 5 software) and the final optical density was determined after the horseradish peroxidase nonspecific background binding was subtracted.

D7324—Capture Enzyme Linked Immunosorbent Assays (ELISAs) for Anti-BG505 Envelope Trimer Responses. 96 well plates (Reacti-Bind®, Pierce) were coated with 100 µl/well of 2 µg/ml of anti-D7324 antibody (Aalto Bioreagents, Dublin, Ireland) in PBS overnight at 4 degrees Celsius. After coating, plates were blocked for 1 hour at room temperature with PBS+5% skim milk (Difco, Bectin, Dickinson and Company). Plates were then washed five times with PBS-T (PBS+0.2% tween-20) before adding 0.5 µg/ml of BG505 SOSIP.664-D7324 trimer diluted in PBS+ 10% FBS for two hours at room temperature. After the addition of the trimer, subsequent procedures mimic the anti-V3 ELISAs except dilutions were made in PBS-T instead of B3T.

HIV-1 Neutralization Assays. Sera from immunized animals were assessed for virus neutralization using previously described methods (Li et al., J. Virol., 79, 10108-10125, 2005). In the single round infection assay, a reduction in a luciferase luminescence indicates neutralization activity. Target cells were TZM-bl cells, which are a clonal HeLa cell line expressing CD4, CXCR4 and CCR5. Upon infection, the HIV-1 viral protein Tat induces a luciferase reporter gene, whose expression is measured as relative light units. Data are represented as the inhibitory reciprocal dilutions of sera required to inhibit either 50% of infection ($IC_{50}$), calculated using a regression fit as previously described.

Example 12

Membrane Anchored HIV-1 Env Ectodomain Trimers

This example illustrates production and antigenicity of exemplary HIV-1 Env ectodomain trimers stabilized in a prefusion mature closed conformation that include a transmembrane domain for anchoring to the cell surface.

Numerous HIV-1 Env ectodomain trimers stabilized in a prefusion mature closed conformation were linked to a transmembrane domain and expressed in cells for anchoring to the cell membrane, as listed below. Variation within the membrane anchored sequences includes strain (including chimeras), single chain or not (e.g., sc15ln (15 A.A. linker between gp120/gp41), sc10ln (10 A.A. linker between gp120/gp41)), stabilizing mutations (e.g., SOS, DS, IP, or combinations thereof), linker between position 664 and the TM domain (e.g., MPER sequence, or 10ln (10 A.A. linker)), TM domain (e.g, HA or HIV-1 TM), and presence or absence of a cytoplasmic tail. Exemplary constructs are listed below TH966.8-chim_sc10ln-IP-10ln-HATM (SEQ ID NO: 1765)

6545.V4.C1-chim_sc10ln-IP-10ln-HATM (SEQ ID NO: 1766)

R2184.c4-chim_sc10ln-IP-10ln-HATM (SEQ ID NO: 1767)

ZM197.7-chim_sc10ln-IP-10ln-HATM (SEQ ID NO: 1768)

ZM106.9-chim_sc10ln-IP-10ln-HATM (SEQ ID NO: 1769)

ZM53.12-chim_sc101ln-IP-10ln-HATM (SEQ ID NO: 1770)

R2184.c4-chim_sc10ln-IP-MPER-TM (SEQ ID NO: 1771)

CNE55-chim_sc10ln-IP-10ln-HATM (SEQ ID NO: 1772)

6545.V4.C1-chim_sc10ln-IP-MPER-TM (SEQ ID NO: 1773)

DU422.01-chim_sc10ln-IP-10ln-HATM (SEQ ID NO: 1774)

25925-2.22-chim_sc10ln-IP-10ln-HATM (SEQ ID NO: 1775)

CNE58-chim_sc101ln-IP-10ln-HATM (SEQ ID NO: 1776)

16055-2.3-chim_sc10ln-IP-10ln-HATM (SEQ ID NO: 1777)

TH966.8-chim_sc10ln-IP-MPER-TM (SEQ ID NO: 1778)

ZM55.28a-chim_sc10ln-IP-MPER-TM (SEQ ID NO: 1779)

ZM53.12-chim_sc10ln-IP-MPER-TM (SEQ ID NO: 1780)

BI369.9A-chim_sc10ln-IP-10ln-HATM (SEQ ID NO: 1781)

ZM197.7-chim_sc10ln-IP-MPER-TM (SEQ ID NO: 1782)

16055-2.3-chim_sc10ln-IP-MPER-TM (SEQ ID NO: 1783)

ZM55.28a-chim_sc15ln-SOS-DS-10ln-HATM (SEQ ID NO: 1784)

A FACS-based assay was used to interrogate the antigenicity of the membrane anchored HIV-1 Env ectodomain trimers. Briefly, expression vectors encoding an immunogen of interest were transfected into cells in a 96-well format. The cells were harvested 2 or 3 days following transfection, and stained with antibodies specific for trimeric HIV-1 Env (such as VRC26, PGT145, or PGT151), non-trimer specific but broadly neutralizing antibodies (such as VRC01 or PGT128) and non-trimer specific poorly neutralizing antibodies (such as 447-52D). The cells were then stained with appropriate secondary antibody, and analyzed by FACS to assay for antigenicity and expression.

FIG. 56 lists the antigenic characteristics of the constructs listed above. The designed with the most desirable antigenic characteristics were those with a single chain HIV-1 Env ectodomain including a 10 amino acid peptide linker between gp120 and gp41, the "IP" substitution, and a 10 amino acid peptide linker or the native MPER sequence between residue 664 of gp41 and a TM domain, such as the HA TM domain or the HIV-1 Env TM domain.

Example 13

HIV-1 Env Ectodomain Trimer Immunogens Based on Ontogeny of Broadly Neutralizing Antibodies This example illustrates chimeric HIV-1 Env ectodomain trimer immunogens stabilized in the prefusion mature closed conformation that include a V1V2 domain sequence that (1) bind to mature broadly neutralizing antibodies that target the V1V2 domain, as well as immature somatic precursors thereof, and that (2) are from a strain of HIV-1 that can be neutralized by V1V2-directed broadly neutralizing antibodies produced by multiple donors.

Antibodies capable of neutralizing a majority of circulating HIV-1 isolates develop in approximately half of those infected with HIV-1 for over five years (Hraber, P. et al. AIDS 28, 163-9 (2014). Intense interest has focused on these antibodies, as they provide clues to how an effective vaccine might be developed (Burton, D. R. et al. Nat Immunol 5, 233-6 (2004); Haynes, B. F., Kelsoe, G., Harrison, S.C. & Kepler, T.B. Nature biotechnology 30, 423-33 (2012). In specific, broadly neutralizing antibodies (bNAbs)—that arise in multiple donors and share common features of Env recognition and B-cell ontogeny—may have utility as vaccine templates, due to the potential for similar antibodies to be elicited by a common immunogen (or common set of immunogens) in the general population (Kwong, P. D. & Mascola, J. R. Immunity 37, 412-25 (2012), Jardine, J. et al. Science 340, 711-6 (2013).

An increasing number of such "multidonor" bNAbs have been identified, such as those of the VRC01 class (named for the first antibody of the class), which share 'class' features of molecular recognition and B-cell ontogeny (Scheid, J. F. et al. Science 333, 1633-7 (2011); Wu, X. et al. Science 333, 1593-602 (2011); Zhou, T. et al. Immunity 39, 245-58 (2013); Zhou, T. et al. Cell 161, 1280-92 (2015)). This commonality has motivated the development of immunogens, designed to target class-specific features of recognition and to overcome class-specific roadblocks in developmental ontogeny, and success with this strategy has been achieved with immunogens capable of priming the initial stage of VRC01-class development in mouse models (Dosenovic, P. et al. Cell 161, 1505-15 (2015); Jardine, J. G. et al. Science 349, 156-61 (2015), each of which is incorporated by reference herein).

Structures of the ligand-free forms of these antibodies reveal a protruding third heavy chain complementarity determining region (CDR H3), which is anionic, often tyrosine sulfated, and critical for Env interaction. The epitope appears to be quaternary in nature and to include an N-linked glycan at residue 160 along with strand C of V1V2.

In terms of B-cell ontogeny, approximations of the unmutated common ancestor (UCA) have been inferred for V1V2-directed bNAb lineages from donors CH0219 and CAP256 (Bonsignori, M. et al. J Virol 85, 9998-10009 (2011); Doria-Rose, N. A. et al. Nature 509, 55-62 (2014), each of which his incorporated by reference herein), which indicate the long anionic CDR H3 to be a product of recombination. Initial recognition of UCA (or of V-gene reverted approximations) appears to be restricted to select strains of HIV-1 (e.g. CAP256-SU or ZM233), to use similar D genes and in some cases related V genes, and to contain similar motifs (e.g. YYD) in the CDR H3.

While antibodies against the same supersite of HIV-1 vulnerability often show diverse modes of recognition, bNAbs against the membrane-distal V1V2 apex of prefusion closed conformation of HIV-1 Env appear to share a number of characteristics. Thus far, V1V2-directed bNAbs have been identified in four donors: the CH0219 donor, with bNAbs CH01-CH04 (Bonsignori, M. et al. J Virol 85, 9998-10009 (2011)); the CAP256 donor, with bNAbs CAP256-VRC26.01-12 (Doria-Rose, N. A. et al. Nature 509, 55-62 (2014); the IAVI 24 donor, with bNAbs PG9 and PG16 (Walker, L. M. et al. Science 326, 285-9 (2009); and the IAVI 84 donor with bNAbs PGT141-145 (Walker, L. M. et al. Nature 477, 466-70 (2011) and PGDM1400-1412 (Sok, D. et al. Recombinant HIV envelope trimer selects for quaternary-dependent antibodies targeting the trimer apex. Proc Natl Acad Sci USA 111, 17624-9 (2014).

Neutralization screening with UCA and intermediates of V1V2-directed bNAbs was used to engineer antigens capable of interacting with developmental intermediates. Altogether the structural similarities in antibody recognition along with ontogeny similarities (and differences) in development indicate the V1V2-directed bNAbs to form an 'extended class', which do not necessarily share genetic commonalities, but nonetheless display a characteristic mode of antigen interaction. Extended-class immunogens—such as the soluble chimeric trimers disclosed herein through an ontogeny-based chimera strategy—provide a general means for eliciting bNAbs against specific sites of Env vulnerability.

V1V2 Chimeras

Several HIV-1 Env molecules that specifically bind to mature broadly neutralizing antibodies that target the V1V2 domain, as well as immature somatic precursors thereof, were identified (FIG. 57). These include Env proteins from the CAP256.SU, BB201.B42, KER2018.11, CH070.1, ZM233.6, Q23.17, A244, T250-4, and WITO.33 strains of HIV-1. To identify the HIV-1 strains shown in FIG. 57, mature and reverted V1V2-directed bNAbs were tested for neutralization across ~200 exemplary HIV-1 isolates. The V1V2 sequence of each of the HIV-1 strains (positions 126-196, HXB2 numbering) is shown, with the A, B, C, C' and D secondary structures indicated.

With regard to FIG. 57, inferred ancestor and intermediates of V1V2-directed bNAbs neutralize a common set of HIV-1 isolates. Mature and reverted V1V2-directed bNAbs were tested for neutralization across ~200 HIV-1 isolates. "Neutralized" represents the number of HIV-1 strains with $IC_{50}$ of less than 50 mg/ml, and "Total" indicates the number of HIV-1 strains tested; $IC_{50}$ for select strains is indicated by an enlarged colored dot. The reverted antibodies were previously identified, see, e.g., Bonsignori et al., J. Virol., 85(19):9998-10009, 2011, which is incorporated by reference herein.

HIV-1 strains neutralized by the broadly neutralizing antibody revertants shown in FIG. 57 were ranked according to probabilities obtained by frequentist analysis, for which enhancement in likelihood of interaction with the earliest neutralizers is provided. The fold enhancement of interaction probability for the selected strains relative to a random strain from the ~200-virus panel using a frequentist approach is shown in the following table, as evaluated based on (i) all 13 antibodies in FIG. 57, (ii) mature antibodies (CH04, PG9, CAP256-CAP256.08, and PGT145), (iii) non-mature antibodies, (iv) germline or UCA antibodies (CH0219-UCA, PG9-gHgL, PGT145-gHgL, CAP256-VRC26.UCA), (v) intermediate antibodies (non-mature or non-germline/UCA), and (vi) earliest neutralizers (CH0219-UCA, PG9-gHgL, PGT145-gHL, CAP256-VRC26.I1). The enhancement of interaction probability for using nine selected strains compared to a random strain is also shown.

CH070.1, ZM233.6, Q23.17, A244, T250-4, or WITO.33 strain as described in this example, with the remainder of the gp120 portion of the HIV-1 Env ectodomain from a HIV-1 Env molecule known to interact with mature and UCA forms of VRC01-class antibodies (such as Env from the clade C 426c strain with N276D, N460D, N463D substitutions (see Wu et al., Cell, 161, 470-485, 2015, which is incorporated by reference herein), or Env from the clade B d45-01dG5 strain (see McGuire et al., J Exp. Med., 210, 655-663, 2013, incorporated by reference herein).

The amino acid sequence of 426c Env with N276D, N460D, N463D substitutions is provided as SEQ ID NO: 2144. The amino acid sequence of d45-01dG5 Env is provided as SEQ ID NO: 2145. These ectodomain trimers have unique antigenic characteristics that provide for bind-

| Strain | All Abs | Mature Abs | Non-Mature Abs | Intermediate Abs | Germline and UCA Abs | Earliest neutralizers |
|---|---|---|---|---|---|---|
| Fold enhancement of interaction probability for each selected strain | | | | | | |
| WITO.33 | 2.07 | 1.23 | 4.28 | 3.45 | 14.98 | 23.02 |
| ZM233.6 | 2.24 | 1.63 | 4.28 | 2.3 | 29.96 | 23.02 |
| T250-4 | 2.36 | 1.63 | 4.28 | 4.6 | 0 | 11.51 |
| CH070.1 | 1.77 | 1.23 | 3.21 | 2.3 | 14.98 | 11.51 |
| BB201.B42 | 2.07 | 1.63 | 3.21 | 2.3 | 14.98 | 11.51 |
| KER2018.11 | 2.07 | 1.63 | 3.21 | 2.3 | 14.98 | 11.51 |
| Q23.17 | 2.07 | 1.63 | 3.21 | 2.3 | 14.98 | 11.51 |
| A244 | 2.36 | 1.63 | 4.28 | 3.45 | 14.98 | 11.51 |
| CAP256.SU | 2.07 | 1.63 | 3.21 | 3.45 | 0 | 11.51 |
| Fold enhancement of interaction probability for using the nine selected strains | | | | | | |
| | 3.25 | 1.63 | 7.48 | 5.76 | 29.96 | 46.04 |

Chimeric HIV-1 Env ectodomain trimer immunogens were produced that include the V1V2 domain sequence (positions 126-196) of the CAP256.SU, BB201.B42, KER2018.11, CH070.1, ZM233.6, Q23.17, A244, T250-4, or WITO.33 strains of HIV-1, with the remainder including BG505.SOSIP.DS.368R sequence (including gp120 positions 31-125 and 197-511 and gp41 positions 512-644), as follows: Q23.17 chimera (SEQ ID NO: 2126), ZM233.6 chimera (SEQ ID NO: 2125), WITO.33 chimera (SEQ ID NO: 2128), A244 chimera (SEQ ID NO: 2127), BB201.B42 chimera (SEQ ID NO: 2122), KER2018.11 chimera (SEQ ID NO: 2123), CH070.1 chimera (SEQ ID NO: 2124), CAP256.SU chimera (SEQ ID NO: 2121), and T-250-4 chimera (SEQ ID NO: 2129).

The transplanted V1V2 region is illustrated in FIG. 58A. FIG. 58B shows an exemplary gel filtration and negative stain EM (2D class averages) of a representative chimera, BG505 SOSIP.664.DS.368R.CAP256-SU. The binding of the soluble chimeric HIV-1 Env ectodomains to the ancestors, intermediates, and mature V1V2-directed bNAbs listed in FIG. 57 was assayed by ELISA (FIG. 58C). Additionally, these chimeric HIV-1 Env ectodomain trimers were incubated with a molar excess of soluble CD4 and tested for binding to 17b mAb—none of the chimeric HIV-1 Env ectodomain trimers specifically bound to 17b in the presence of sCD4. Further, each of the chimeric HIV-1 Env ectodomain trimers did not specifically bind to the poorly neutralizing antibody 447-52D, but did specifically bind to V1V2 targeted broadly neutralizing antibodies such as PGT145, VRC26, PGT121, and/or 2G12.

426c and d45-01dG5 Chimeras

Additional chimeras were generated that combine the BG505 "platform" described in Example 5, with a V1V2 domain from a CAP256.SU, BB201.B42, KER2018.11, ing to mature and UCA forms of multiple classes or broadly neutralizing antibodies (targeting the CD4 binding site and the V1V2 domain) and can be used to induce an immune response to HIV-1 Env in a subject. These immunogens are of particular interest for use as a "prime" immunogen in a prime-boost immunization protocol for eliciting an immune response to HIV-1 Env.

The chimeric Env ectodomains included the sequences from the following (HXB2 numbering):

For the 426c chimera:
  BG505 "platform": 31-45 and 478-507, 512-664;
  V1V2 domain: positions 126-196 from CAP256.SU, BB201.B42, KER2018.11, CH070.1, ZM233.6, Q23.17, A244, T250-4, or WITO.33
  426c: 46-125, 197-478
  This chimeric Env ectodomain further included SOSIP substitutions, DS substitutions (201C/433C), and N276D, N460D, N463D substitutions to eliminate the glycosylation sites at positions 276, 460, 463.

For the d45-01dG5 chimera:
  BG505: 31-45 and 478-507, 512-664 with SOSIP substitutions;
  V1V2 domain: 126-196 positions 126-196 from CAP256.SU, BB201.B42, KER2018.11, CH070.1, ZM233.6, Q23.17, A244, T250-4, or WITO.33
  This chimeric Env ectodomain further included SOSIP substitutions and DS substitutions (201C/433C). The donor 45_01dG5 Env naturally lacks a glycan at 276 and 460 and this is sufficient to allow UCA forms of VRC-01 class antibodies to bind. Specific examples of sequences of such chimeric HIV-1 Env ectodomains are provided as SEQ ID NOs: 2146-2159.

As proof-of-principle, a chimera was generated that includes the BG505 "platform" (positions 31-45 and 478-

507, 512-664), with the remainder of gp120 from the 426c strain with mutations of the glycan sequon at positions 276, 460 and 463, and the "DS" substitutions (201C/433C) and tested antigenically (FIG. 60). This construct bound to VRC20 gHgL and VRC01 gHgL UCA antibodies, as well as the indicated neutralizing antibodies.

UCA and intermediate matured antibodies related to known broadly neutralizing antibodies that can be used to interrogate the antigenicity of the disclosed chimeras are known. Non-limiting examples include UCA and intermediate matured antibodies related to VRC26, PGT145, CH01, PG9 (see, e.g., Alam et al., PNAS, 110, 18214-9, 2013; Bonsignori et al, J Virol, 85, 9998-10009, 2011; Bonsignori et al, J Virol, 86, 4688-4692, 2012; doria-rose et al, Nature, 509, 55-62, 2014; Pancera et al., J Virol, 84, 8098-8110, 2010; Walker et al., Nature, 477, 466-470, 2011; each of which is incorporated by reference herein) and VRC01 (see, e.g., Jardine, J. et al. *Science* 340, 711-6, 2013, which is incorporated by reference herein).

Example 14

Recombinant HIV-1 Env Ectodomain Trimers Including BG505 and JRFL Sequences

This example describes chimeric HIV-1 Env ectodomain trimers that include chimeric sequences having a BG505 gp120 positions 46-54, 70-75, 84-89, 99, 102, 106, 107, 114, 215, 220-224, 226, 244, 471-473, and 476-477. Some constructs also included BG505 sequence for particular structural elements, such as the:

V1 loop (gp120 positions 119-153)
V2 loop (gp120 positions 154-205)
Strand C of the V1V2 domain (gp120 positions 166-173)
V3 domain (gp120 positions 296-331)
Positions 191-205
V2 loop and V3 domain
Strand C and V3 domain
Positions 191-205 and Strand C
V1 and V3
V1, Strand C, and V3
V1, V2, and V3

HIV1 Env positions 191-205 are a set of residues in strand D of the V1V2 which forms extensive contacts with the B20-B21 sheets and may help to stabilize the chimeric JRFL molecule. The recombinant HIV-1 Env proteins also included the SOSIP and 201C/433C substitutions (for stabilization) and an E168K substitution to maximize binding to V1V2-directed broadly neutralizing antibodies.

The JRFL sequence was used for the remaining HIV-1 Env sequence. The following recombinant HIV-1 Env ectodomain trimers were expressed according to methods described in Examples 1 and 2, and their antigenicity was assayed using a panel of antibodies (FIG. 59).

| Name | Chimeric positions | SEQ ID NO |
|---|---|---|
| JRFLgp140.6R.SOSIP.664.E168K, BG505 gp41 chim, I201C, A433C,__v2__v3 | BG505: gp120 positions 31-45 and 478-507, V2, V3, gp41 512-664; JRFL: remainder | 1732 |
| JRFLgp140.6R.SOSIP.664.E168K, BG505 gp41 chim, I201C, A433C,__v3 | BG505: gp120 positions 31-45 and 478-507, V3; gp41 512-664; JRFL: remainder | 1735 |
| JRFLgp140.6R.SOSIP.664.E168K, BG505 gp41 chim, +int I201C, A433C,__strC__v3 | BG505: gp120 positions 31-45 and 478-507, Int. Res. Set A, Strand C, V3; gp41 512-664; JRFL: remainder | 1736 |
| JRFLgp140.6R.SOSIP.664.E168K, BG505 gp41 chim, +int I201C, A433C,__191-205__v3 | BG505: gp120 positions 31-45 and 478-507, Int. Res. Set A, positions 191-205, V3; gp41 512-664; JRFL: remainder | 1738 |
| JRFLgp140.6R.SOSIP.664.E168K, BG505 gp41 chim, +int I201C, A433C,__v1__v3 | BG505: gp120 positions 31-45 and 478-507, Int. Res. Set A, positions 191-205, V1, V3; gp41 512-664; JRFL: remainder | 1739 |
| JRFLgp140.6R.SOSIP.664.E168K, BG505 gp41 chim, +int I201C, A433C,__v3 | BG505: gp120 positions 31-45 and 478-507, Int. Res. Set A, V3; gp41 512-664; JRFL: remainder | 1741 |
| JRFLgp140.6R.SOSIP.664.E168K, BG505 gp41 chim, +int I201C, A433C,__v2__v3 | BG505: gp120 positions 31-45 and 478-507, Int. Res. Set A, V2, V3; gp41 512-664; JRFL: remainder | 1742 |
| JRFLgp140.6R.SOSIP.664.E168K, BG505 gp41 chim, +int I201C, A433C,__v1__strC__v3 | BG505: gp120 positions 31-45 and 478-507, Int. Res. Set A, V1, Strand C, V3; gp41 512-664; JRFL: remainder | 1744 |
| JRFLgp140.6R.SOSIP.664.E168K, BG505 gp41 chim, I201C, A433C,__v1__v3 | BG505: gp120 positions 31-45 and 478-507, V1, V3; gp41 512-664; JRFL: remainder | 1758 |
| JRFLgp140.6R.SOSIP.664.E168K, BG505 gp41 chim, +int I201C, A433C,__v1__191-205__v3 | BG505: gp120 positions 31-45 and 478-507, Int. Res. Set A, V1, positions 191-205, V3; gp41 512-664; JRFL: remainder | 1759 |
| JRFLgp140.6R.SOSIP.664.E168K, BG505 gp41 chim, I201C, A433C,__191-205__v3 | BG505: gp120 positions 31-45 and 478-507, positions 191-205, V3; gp41 512-664; JRFL: remainder | 1760 |
| JRFLgp140.6R.SOSIP.664.E168K, BG505 gp41 chim, +int I201C, A433C,__strC__191-205__v3 | BG505: gp120 positions 31-45 and 478-507, Int. Res. Set A, Strand C, positions 191-205, V3; gp41 512-664; JRFL: remainder | 1761 |
| JRFLgp140.6R.SOSIP.664.E168K, BG505 gp41 chim, +int I201C, A433C,__v1__v2__v3 | BG505: gp120 positions 31-45 and 478-507, Int. Res. Set A, V1, V2, V3; gp41 512-664; JRFL: remainder | 1762 |
| JRFLgp140.6R.SOSIP.664.E168K, BG505 gp41 chim, I201C, A433C,__v1__strC__v3 | BG505: gp120 positions 31-45 and 478-507, V1, Strand C, V3; gp41 512-664; JRFL: remainder | 1763 |

"platform," as well as other BG505 structural elements (such as a V1, V2, and/or V3 domain), with the remaining sequence of the HIV-1 ectodomain based on the JRFL strain of HIV-1.

Chimeric HIV-1 Env ectodomains were expressed that include HIV-1 Env positions 31-507 joined by a 6R cleavable linker to gp41 positions 512-664. The BG505 sequence was used for gp120 positions 31-45 and 478-507 and gp41 residues 512-664. Some constructs also included BG505 residues for "Interface Residue Set A" or "Int. Res. Set A:"

Each of the recombinant HIV-1 Env ectodomain trimers listed in the above table also included the SOSIP, R6, 664, E168K, I201C, and A433C substitutions.

As illustrated in FIG. 59, each of these recombinant HIV-1 Env ectodomain trimers has substantially reduced binding to 17b antibody in the presence of sCD4 compared to control BG505.SOSIP, and bound to prefusion mature closed conformation targeted antibodies, such as PGT145. The binding assays were performed as described in Examples 1 and 2. The reduced binding to VRC26 of JRFL based constructs is due to the fact that this antibody interacts poorly with JRFL Env.

Example 15

The following table (Table 13) provides a description of sequences provided herein. Sequence of particular interest for use as immunogens to induce an immune response to HIV-1 Env are marked with a "*"

| SEQ ID NO | Code | Name | Native Background | Mutations Compared to Native Background | Additional mutations | Comment |
|---|---|---|---|---|---|---|
| 0001 | 0 | HXB2 | MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLK CTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLL LNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQL FNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKRAVGIGALFL GFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQ NQQEKNEQELLELDKWASLWNWFNITNWLWYIKLFIMIVGGLVGLRIVFAVLSIVNRVRQGYSLSFQTHLPTPRGPDRPEGIEEEGGERDRSIRLVNGSLALIWDDLRSLCLFSYHRLRDLLLIVTR IVELLGRRGWEALKYWWNLLQYWSQELKNSAVSLLNATAIAVAEGTDRVIEVVQGACRAIRHIPRRIRQGLERILL | | | |
| 0002 | 0 | BG505 | MRVMGIQRNCQHLFRWGTMLLGMIIICSAAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQC TNVTNNITDDMRGELKNCSFNMTTELRDKKQKVYSLFYRLDVVQINENQNGRSNNSNKEYRLINCNTSAITTQACPKVSFEPIPIHYCAPAGFAILKCKDKKFNGTGPCPSVSTVQCTHGIKPVVSTQLLL NGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTHSFNCGGEFFYCNTSGLFN STWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGREKRAVGIGAVFLGFL GAAGSTMGAASMITLTVQARNLLSGIVQQQSNLLRAIEAQQHLKLTVWGIKQLQARVLAVERYLKDQQLLGIWGCSGKLICTTNVPWNSSWSNRNLSEIWDNMTWLQWDKEISNYTQIIYGLLEESQNQQ EKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVE LLGHSSLKGLRLGWEGLKYLWNLLAYWGRELKISAINLFDTIAIAVAEWTDRVIEIGQRLCRAFLHIPRRIRQGLERALL | | | |
| 0003 | A001 | BG505 SOSIP | BG505 | SOSIP | | |
| 0004 | A002 | BG505.SOSIP.R6.664.T332N | BG505 | SOSIP, R6, 664, T332N | | |
| 0005 | A003 | BG505.SOSIP.R6.664.T332N_Y191F | BG505 | SOSIP, R6, 664, T332N | Y191F | Stabilized V1V2 cap |
| 0006 | A004 | BG505.SOSIP.R6.664.T332N_Y191W | BG505 | SOSIP, R6, 664, T332N | Y191W | Stabilized V1V2 cap |
| 0007 | A005 | BG505.SOSIP.R6.664.T332N_A433P | BG505 | SOSIP, R6, 664, T332N | A433P | Disrupt CD4-bound sheet conf. |
| 0008 | A006 | BG505.SOSIP.R6.664.T332N_Q432P | BG505 | SOSIP, R6, 664, T332N | Q432P | Disrupt CD4-bound sheet conf. |
| 0009 | A007 | BG505.SOSIP.R6.664.T332N_S174C/A319C | BG505 | SOSIP, R6, 664, T332N | S174C/A319C | DS (disulfide) |
| 0010 | A008 | BG505.SOSIP.R6.664.T332N_L175C/T320C | BG505 | SOSIP, R6, 664, T332N | L175C/T320C | DS |
| 0011 | A009 | BG505.SOSIP.R6.664.T332N_P220C/A578C | BG505 | SOSIP, R6, 664, T332N | P220C/A578C | DS |
| 0012 | A010 | BG505.SOSIP.R6.664.T332N_A221C/A582C | BG505 | SOSIP, R6, 664, T332N | A221C/A582C | DS |
| 0013 | A011 | BG505.SOSIP.R6.664.T332N_A200C/P313C | BG505 | SOSIP, R6, 664, T332N | A200C/P313C | DS |
| 0014 | A012 | BG505.SOSIP.R6.664.T332N_498C/W610C | BG505 | SOSIP, R6, 664, T332N | 498C/W610C | DS |
| 0015 | A013 | BG505.IP.R6.664.T332N_G41C/Q540C | BG505 | IP, R6, 664, T332N | G41C/Q540C | DS-non SOS context |
| 0016 | A014 | BG505.IP.R6.664.T332N_P43C/A526C | BG505 | IP, R6, 664, T332N | P43C/A526C | DS-non SOS context |
| 0017 | A015 | BG505.IP.R6.664.T332N_A221C/A582C | BG505 | IP, R6, 664, T332N | A221C/A582C | DS-non SOS |
| 0018 | A016 | BG505.SOSIP.R6.664.T332N_G527C/N88C | BG505 | SOSIP, R6, 664, T332N | G527C/N88C | DS |

-continued

| 1<br>SEQ<br>ID NO | 2<br>Code | 3<br>Name | 4<br>Native<br>Background | 5<br>Mutations Compared to<br>Native Background | 6<br>Additional mutations | 7<br>Comment |
|---|---|---|---|---|---|---|
| 0018 | A016 | BG505.SOSIP.R6.664.T332N_Q540C/P43C | BG505 | SOSIP, R6, 664, T332N | Q540C/P43C | DS |
| 0019 | A017 | BG505.SOSIP.R6.664.T332N_E164C/N197C | BG505 | SOSIP, R6, 664, T332N | E164C/N197C | DS |
| 0020 | A018 | BG505.SOSIP.R6.664.T332N_P124C/R166C | BG505 | SOSIP, R6, 664, T332N | P124C/R166C | DS |
| 0021 | A019 | BG505.SOSIP.R6.664.T332N_D180C/I423C | BG505 | SOSIP, R6, 664, T332N | D180C/I423C | DS |
| 0022 | A020 | BG505.SOSIP.R6.664.T332N_N195C/I423C | BG505 | SOSIP, R6, 664, T332N | N195C/I423C | DS |
| 0023 | A021 | BG505.SOSIP.R6.664.T332N_N195C/A433C | BG505 | SOSIP, R6, 664, T332N | N195C/A433C | DS |
| 0024 | A022 | BG505.SOSIP.R6.664.T332N_S199C/A433C | BG505 | SOSIP, R6, 664, T332N | S199C/A433C | DS |
| 0025 | A023 | BG505.SOSIP.R6.664.T332N_S199C/G431C | BG505 | SOSIP, R6, 664, T332N | S199C/G431C | DS |
| 0026 | A024 | *BG505.SOSIP.R6.664.T332N_I201C/A433C | BG505 | SOSIP, R6, 664, T332N | I201C/A433C | DS |
| | AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDK<br>KQKVYSLFYRLDVVQINENQGNRSNNSNKEYRLINCNTSAcTQACPKVSFEPIPIHYCAPAGFAILKCKDKKFNGTGPCPSVSTVQCTHGIKPVVSTQLLLNGSLAEEEVMIRSENITNNAKNILVQFNT<br>PVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQ<br>IINMWQRIGQcMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQ<br>QQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | | |
| 0027 | A025 | BG505.SOSIP.R6.664.T332N_T320C/P438C | BG505 | SOSIP, R6, 664, T332N | T320C/P438C | DS |
| 0028 | A026 | BG505.SOSIP.R6.664.T332N_D180C/K421C | BG505 | SOSIP, R6, 664, T332N | D180C/K421C | DS |
| 0029 | A027 | BG505.SOSIP.R6.664.T332N_M530W | BG505 | SOSIP, R6, 664, T332N | M530W | CavF at gp41-tryptophan clasp. Stabilize gp41-tryptophan clasp interactions |
| 0030 | A028 | BG505.SOSIP.R6.664.T332N_F159Y | BG505 | SOSIP, R6, 664, T332N | F159Y | CavF at gp120 V1/V2. Substitute Y or W, stabilize V1/V2/V3 |
| 0031 | A029 | BG505.SOSIP.R6.664.T332N_F223W | BG505 | SOSIP, R6, 664, T332N | F223W | CavF at gp120 beta-5. Substitute Y or W. stabilize gp120/gp41 interface |
| 0032 | A030 | BG505.SOSIP.R6.664.T332N_L544Y_F223W | BG505 | SOSIP, R6, 664, T332N | L544Y, F223W | CavF at gp41 tip of α-6. 544: F, Y, or W 223: Y or W. stabilize gp120/gp41 interface |
| 0033 | A031 | BG505.SOSIP.R6.664.T332N_L523F | BG505 | SOSIP, R6, 664, T332N | L523F | Fusion Peptide Cavity Fill |
| 0034 | A032 | BG505.SOSIP.R6.664.T332N_F522Y | BG505 | SOSIP, R6, 664, T332N | F522Y | Fusion Peptide Cavity Fill |
| 0035 | A033 | BG505.SOSIP.R6.664.T332N_W35Q | BG505 | SOSIP, R6, 664, T332N | W35Q | Exposed Nterm hydrophobic resurfaced |

-continued

| SEQ ID NO | Code | Name | Native Background | Mutations Compared to Native Background | Additional mutations | Comment |
|---|---|---|---|---|---|---|
| 0036 | A034 | BG505.SOSIP.R6.664.T332N_A200C/P313C_A221C/A582C | BG505 | SOSIP, R6, 664, T332N | A200C/P313C, A221C/A582C | nonSOS_multiple cyscys |
| 0037 | A035 | BG505.SOSIP.R6.664.T332N_Q432E | BG505 | SOSIP, R6, 664, T332N | Q432E | Disrupt CD4-bound sheet conf. |
| 0038 | A036 | BG505.SOSIP.R6.664.T332N_Q432D | BG505 | SOSIP, R6, 664, T332N | Q432D | Disrupt CD4-bound sheet conf. |
| 0039 | A037 | BG505.SOSIP.R6.664.T332N_M434P | BG505 | SOSIP, R6, 664, T332N | M434P | Disrupt CD4-bound sheet conf. |
| 0040 | A038 | BG505.SOSIP.R6.664.T332N_Y435P | BG505 | SOSIP, R6, 664, T332N | Y435P | Disrupt CD4-bound sheet conf. |
| 0041 | A039 | BG505.SOSIP.R6.664.T332N_A436P | BG505 | SOSIP, R6, 664, T332N | A436P | Disrupt CD4-bound sheet conf. |
| 0042 | A040 | BG505.SOSIP.R6.664.T332N_P437A | BG505 | SOSIP, R6, 664, T332N | P437A | proline removal |
| 0043 | A041 | BG505.SOSIP.R6.664.T332N_P438A | BG505 | SOSIP, R6, 664, T332N | P438A | proline removal |
| 0044 | A042 | BG505.SOSIP.R6.664.T332N_P438A.P437A | BG505 | SOSIP, R6, 664, T332N | P437A, P438A | proline removal |
| 0045 | A043 | BG505.SOSIP.R6.664.T332N_T139W.I326R | BG505 | SOSIP, R6, 664, T332N | T139W, I326R | CavF at the interface of V1V2 and V3 loops. Susitute- T139: F, M, I, Y; I326: M, W, F, Y. stabilize V1V2/V3 loop interactions in mature closed state |
| 0046 | A044 | BG505.SOSIP.R6.664.T332N_L179W | BG505 | SOSIP, R6, 664, T332N | L179W | CavF at V1V2 loop gp120 core interface. Substitute- F, Y, M, I. stabilize interaction between V1V2 loop and gp120 core in mature closed state |
| 0047 | A045 | BG505.SOSIP.R6.664.T332N_Y39F.S534V | BG505 | SOSIP, R6, 664, T332N | Y39F, S534V | CavF. add hydrophobicity at gp120/gp41 interface Substitute- S534: I, W, F, A, M; Y39: W, M, I |
| 0048 | A046 | BG505.SOSIP.R6.664.T332N_Y39W.S534A | BG505 | SOSIP, R6, 664, T332N | Y39W, S534A | CavF. add hydrophobicity at gp120/gp41 interface. A |
| 0049 | A047 | BG505.SOSIP.R6.664.T332N_39F.S534V.T37V.T499V | BG505 | SOSIP, R6, 664, T332N | Y39F, S534V, T37V, T499V | CavF. add hydrophobicity at gp120/gp41 interface |
| 0050 | A048 | BG505.SOSIP.R6.664.T332N_Y39F.Y40F.S534V.T37V.T499V | BG505 | SOSIP, R6, 664, T332N | Y39F, Y40F, S534V, T37V, T499V | CavF. add hydrophobicity at gp120/gp41 interface |
| 0051 | 0 | CAP256.SU | CAP256.SU | | | |
| 0052 | A049 | BG505.SOSIP.R6.664.T332N_N425C I430C | BG505 | SOSIP, R6, 664, T332N | N425C/I430C | DS- Stabilizes CD4 binding loop |

| SEQ ID NO | Code | Name | Native Background | Mutations Compared to Native Background | Additional mutations | Comment |
|---|---|---|---|---|---|---|
| 0053 | A050 | BG505.SOSIP.R6.664.T332N_Y318C_P437C_G473A | BG505 | SOSIP, R6, 664, T332N | Y318C/437C, G473A | DS- Restrain PGT122 bound conformation; reduce CD4 binding |
| 0054 | A051 | BG505.SOSIP.R6.664.T332N_M426W | BG505 | SOSIP, R6, 664, T332N | M426W | CavF at CD4bs. Substitute- F, Y, L, V, I. Constrains CD4 binding loop |
| 0055 | A052 | BG505.SOSI -continued

| SEQ ID NO | Code | Name | Native Background | Mutations Compared to Native Background | Additional mutations | Comment |
|---|---|---|---|---|---|---|
| 0069 | A066 | BG505.SOSIP.R6.664.T332N_N425C_A433C | BG505 | SOSIP, R6, 664, T332N | N425C/A433C | DS- Fixes PGT122 bound state |
| 0070 | A067 | BG505.SOSIP.R6.664.T332N_V120C_Q315C | BG505 | SOSIP, R6, 664, T332N | V120C/Q315C | DS- Fixes PGT122 bound state |
| 0071 | A068 | BG505.SOSIP.R6.664.T332N_P124C_T164C | BG505 | SOSIP, R6, 664, T332N | P124C/T164C | DS- Fixes PGT122 bound state |
| 0072 | A069 | BG505.SOSIP.R6.664.T332N_T128C_T167C_G473A | BG505 | SOSIP, R6, 664, T332N | T128C/T167C, G473A | DS- Restrain PGT122 bound conformation; reduce CD4 binding |
| 0073 | A070 | BG505.SOSIP.R6.664.T332N_I424C_F382C | BG505 | SOSIP, R6, 664, T332N | I424C/F382C | DS- Fixes PGT122 bound state |
| 0074 | A071 | BG505.SOSIP.R6.664.T332N_R298C_A329C | BG505 | SOSIP, R6, 664, T332N | R298C/A329C | DS- Fixes PGT122 bound state |
| 0075 | A072 | BG505.SOSIP.R6.664.T332N_M426P | BG505 | SOSIP, R6, 664, T332N | M426P | CavF at CD4bs. Substitute- P. Rigidifies CD4 binding loop |
| 0076 | A073 | BG505.SOSIP.R6.664.T332N_Y191W_G473A | BG505 | SOSIP, R6, 664, T332N | Y191W G473A | CavF at CD4bs and V1/V2 cap |
| 0077 | A074 | BG505.SOSIP.R6.664.T332N_Q203C_L122C | BG505 | SOSIP, R6, 664, T332N | Q203C/L122C | DS- Fixes PGT122 bound state |
| 0078 | A075 | BG505.SOSIP.R6.664.T332N_M426A | BG505 | SOSIP, R6, 664, T332N | M426A | CavF at CD4bs. Substitute- G, V, I, L, F, Y, W, R, K. prevents triggering on CD4 binding |
| 0079 | A076 | BG505.SOSIP.R6.664.T332N_Y191W_A433P | BG505 | SOSIP, R6, 664, T332N | Y191W A433P | CavF at CD4bs and V1/V2 cap |
| 0080 | A077 | BG505.SOSIP.R6

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0090 | A086 | BG505.SOSIP.R6.664.T332N_V75W | BG505 | SOSIP, R6, 664, T332N | V75W | CavF at gp120/gp41 interface |
| 0091 | A087 | BG505.SOSIP.R6.664.T332N_V75F | BG505 | SOSIP, R6, 664, T332N | V75F | CavF at gp120/gp41 interface |
| 0092 | A088 | BG505.SOSIP.R6.664.T332N_V75M | BG505 | SOSIP, R6, 664, T332N | V75M | CavF at gp120/gp41 interface |
| 0093 | A089 | BG505.SOSIP.R6.664.T332N_V208W | BG505 | SOSIP, R6, 664, T332N | V208W | CavF between α1 and the strand leading into what forms the bridging sheet in the CD4-bound form. Destabilize CD4-bound state |
| 0094 | A090 | BG505.SOSIP.R6.664.T332N_V208Y | BG505 | SOSIP, R6, 664, T332N | V208Y | Same as Seq_0093 |
| 0095 | A091 | BG505.SOSIP.R6.664.T332N_V208F | BG505 | SOSIP, R6, 664, T332N | V208F | Same as Seq_0093 |
| 0096 | A092 | BG505.SOSIP.R6.664.T332N_V208M | BG505 | SOSIP, R6, 664, T332N | V208M | Same as Seq_0093 |
| 0097 | A093 | BG505.SOSIP.R6.664.T332N_A58C/T77C | BG505 | SOSIP, R6, 664, T332N | A58C/T77C | helix 0 disruption |
| 0098 | A094 | BG505.SOSIP.R6.664.T332N_D57C/T77C | BG505 | SOSIP, R6, 664, T332N | D57C/T77C | helix 0 disruption |
| 0099 | A095 | BG505.SOSIP.R6.664.T332N_V68C/S209C | BG505 | SOSIP, R6, 664, T332N | V68C/S209C | helix 0 disruption |
| 0100 | A096 | BG505.SOSIP.R6.664.T332N_V68C/V208C | BG505 | SOSIP, R6, 664, T332N | V68C/208C | helix 0 disruption |
| 0101 | A097 | BG505.SOSIP.R6.664.T332N_V66C/S209C | BG505 | SOSIP, R6, 664, T332N | V66C/S209C | helix 0 disruption |
| 0102 | A098 | BG505.SOSIP.R6.664.T332N_N67P | BG505 | SOSIP, R6, 664, T332N | N67P | helix 0 disruption |
| 0103 | A099 | BG505.SOSIP.R6.664.T332N_H66P | BG505 | SOSIP, R6, 664, T332N | N66P | helix 0 disruption |
| 0104 | A100 | BG505.SOSIP.R6.664.T332N_N67P/H66P | BG505 | SOSIP, R6, 664, T332N | N67P/H66P | helix 0 disruption |
| 0105 | A101 | BG505.SOSIP.R6.664.T332N_A58C/T77C/N67P/H66P | BG505 | SOSIP, R6, 664, T332N | A58C/T77C, N67P, H66P | helix 0 disruption |
| 0106 | A102 | BG505.SOSIP.R6.664.T332N_D57C/T77C/N67P/H66P | BG505 | SOSIP, R6, 664, T332N | D57C/T77C, N67P, H66P | helix 0 disruption |
| 0107 | 0 | KER2018.11 | KER2018.11 | | | |
| 0108 | A103 | BG505.SOSIP.R6.664.T332N_V68C/V208C/N67P/H66P | BG505 | SOSIP, R6, 664, T332N | V68C/V208C, N67P, H66P | helix 0 disruption |
| 0109 | A104 | BG505.SOSIP.R6.664.T332N_V68C/S209C/N67P/H66P | BG505 | SOSIP, R6, 664, T332N | V68C/S209C, N67P, H66P | helix 0 disruption |

| SEQ ID NO | Code | Name | Native Background | Mutations Compared to Native Background | Additional mutations | Comment |
|---|---|---|---|---|---|---|
| 0110 | A105 | BG505.SOSIP.R6.664.T332N_D474A/R476A | BG505 | SOSIP, R6, 664, T332N | D474A,R476A | Destabilization of CD4 binding site |
| 0111 | A106 | BG505.SOSIP.R6.664.T332N_W112I | BG505 | SOSIP, R6, 664, T332N | W112

-continued

| SEQ ID NO | Code | Name | Native Background | Mutations Compared to Native Background | Additional mutations | Comment |
|---|---|---|---|---|---|---|
| 0124 | A119 | BG505.SOSIP.R6.664.T332N_G431.GC.S199C | BG505 | SOSIP, R6, 664, T332N | G431GC/S199C | DS |
| 0125 | A120 | BG505.SOSIP.R6.664.T332N_R166C.V127GC | BG505 | SOSIP, R6, 664, T332N | R166C/V127GC | DS |
| 0126 | A121 | BG505.SOSIP.R6.664.T332N_G314C.S199C | BG505 | SOSIP, R6, 664, T332N | G314C/S199C | DS |
| 0127 | A122 | BG505.SOSIP.R6.664.T332N_G314CG.S199C | BG505 | SOSIP, R6, 664, T332N | G314CG/S199C | DS |
| 0128 | A123 | BG505.SOSIP.R6.664.T332N_V120W | BG505 | SOSIP, R6, 664, T332N | V120W | CavF at N-term of β-2. Substitute- F, W, Y, L, I, M. β-2 extends in cd4-bound state, this stabilizes small hydrophobic pocket in ground state |
| 0129 | A124 | BG505.SOSIP.R6.664.T332N_V120W.Q203V | BG505 | SOSIP, R6, 664, T332N | V120W, Q203V | Same as Seq_0128 |
| 0130 | A125 | BG505.SOSIP.R6.664.T332N_deltaP124 | BG505 | SOSIP, R6, 664, T332N | delP124 | proline removal. Removal of ground state destabilization/flexibility |
| 0131 | A126 | BG505.SOSIP.R6.664.T332N_L125W_deltaP124 | BG505 | SOSIP, R6, 664, T332N | L125W, delP124 | Proline removal and CavF at Cavity between N-term of V1V2 domain and V3 near Res. 127 and 126-196 disulfide of V1V2. Substitute- F, W, Y, L, I, M, V. Removal of ground state destabilization/flexibility |
| 0132 | A127 | BG505.SOSIP.R6.664.T332N_R151E.E153W.Q328W | BG505 | SOSIP, R6, 664, T332N | R151E, E153W, Q328W | CavF at V1 loop at resi 153. Substitute- 153: F, W, Y, L, I, M, V; 328 F, W, Y, L, I, M, V. Adding hydrophobic patch at V1 loop to V3 loop |
| 0133 | A128 | BG505.SOSIP.R6.664.T332N_F159W | BG505 | SOSIP, R6, 664, T332N | F159W | CavF at Primary hydrophobic pocket between V1V2 and V3 near resi 159. Substitute- W or Y. Stabilizing the hydrophobic core of the V1V2-V3 interactions |
| 0134 | A129 | BG505.SOSIP.R6.664.T332N_F317W | BG505 | SOSIP, R6, 664, T332N | F317W | Same as Seq_0133 |
| 0135 | A130 | BG505.SOSIP.R6.664.T332N_M161W | BG505 | SOSIP, R6, 664, T332N | M161W | CavF at Hydrophobic patch at Cterm of V1V2 strand B. Substitute- F, W, Y, L, I. Stabilizing strand B to V3 near trimeric interface |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0136 | A131 | BG505.SOSIP.R6.664.T332N_I309W | BG505 | SOSIP, R6, 664, T332N | I309W | Same as Seq_0135 |
| 0137 | A132 | BG505.SOSIP.R6.664.T332N_L125R.F317D | BG505 | SOSIP, R6, 664, T332N | L125R, F317D | Salt bridge. Salt bridge interaction in hyrophobiic shell |
| 0138 | A133 | BG505.SOSIP.R6.664.T332N_L125WE.F317R | BG505 | SOSIP, R6, 664, T332N | L125WE, F317R | Salt bridge. Salt bridge interaction in hydrophobic shell |
| 0139 | A134 | BG505.SOSIP.R6.664.T332N_S115W | BG505 | SOSIP, R6, 664, T332N | S115W | CavF at C-term of α-1. Substitute- F, W, Y, L, I, M, V. Will fill cavity at top of α-1 which shifts conformation in CD4-bound state |
| 0140 | A135 | BG505.SOSIP.R6.664.T332N_P118W | BG505 | SOSIP, R6, 664, T332N | P118W | CavF/proline removal at C-term of α-1. Substitute- F, W, Y, L, I, M, V. Will fill cavity at top of α-1 which shifts conformation in CD4-bound state |
| 0141 | A136 | BG505.SOSIP.R6.664.T332N_P206A | BG505 | SOSIP, R6, 664, T332N | P206A | proline removal. Removal of ground state destabilization/flexibility |
| 0142 | A137 | BG505.SOSIP.R6.664.T332N_deltaP206 | BG505 | SOSIP, R6, 664, T332N | delP206 | proline removal. Removal of ground state destabilization/flexibility |
| 0143 | A138 | BG505.SOSIP.R6.664.T332N_A70Y | BG505 | SOSIP, R6, 664, T332N | A70Y | CavF- extension of hydrophobc/aromatic patch-gp41/gp120 stabilization (a7/a0cavity close to A70). Substitute- F, Y, W |
| 0144 | A139 | BG505.SOSIP.R6.664.T332N_A70F | BG505 | SOSIP, R6, 664, T332N | A70F | Same as Seq_0143 |
| 0145 | A140 | BG505.SOSIP.R6.664.T332N_L111Y | BG505 | SOSIP, R6, 664, T332N | L111Y | Same as Seq_0143 |
| 0146 | A141 | BG505.SOSIP.R6.664.T332N_L111F | BG505 | SOSIP, R6, 664, T332N | L111F | Same as Seq_0143 |
| 0147 | A142 | BG505.SOSIP.R6.664.T332N_T202P | BG505 | SOSIP, R6, 664, T332N | T202P | disrupt bridging sheet/destabilizing CD4 bound state |
| 0148 | A143 | BG505.SOSIP.R6.664.T332N_V120P | BG505 | SOSIP, R6, 664, T332N | V120P | Same as Seq_0147 |
| 0149 | A144 | BG505.SOSIP.R6.664.T332N_V120T | BG505 | SOSIP, R6, 664, T332N | V120T | Same as Seq_0147 |
| 0150 | A145 | BG505.SOSIP.R6.664.T332N_L122K | BG505 | SOSIP, R6, 664, T332N | L122K | Same as Seq_0147 |

| SEQ ID NO | Code | Name | Native Background | Mutations Compared to Native Background | Additional mutations | Comment |
|---|---|---|---|---|---|---|
| 0151 | A146 | BG505.SOSIP.R6.664.T332N_P313C/A200C/T51C/K574C | BG505 | SOSIP, R6, 664, T332N | P313C/A200C, T51C/K574C Ds | |
| 0152 | A147 | BG505.SOSIP.R6.664.T332N_P313C/A200C/F53C/K574C | BG505 | SOSIP, R6, 664, T332N | P313C/A200C, F53C/K574C Ds | |
| 0153 | A148 | BG505.SOSIP.R6.664.T332N_P313C/A200C/T51C/A578C | BG505 | SOSIP, R6, 664, T332N | P313C/A200C, T51C/A578C Ds | |
| 0154 | A149 | BG505.SOSIP.R6.664.T332N_T128C/L165C/P313C/A200C/T51C/K574C | BG505 | SOSIP, R6, 664, T332N | T128C/L165C, P313C/A200C, T51C/K574C | |
| 0155 | A150 | BG505.SOSIP.R6.664.T332N_T128C/L165C/P313C/A200C/F53C/K574C | BG505 | SOSIP, R6, 664, T332N | T128C/L165C, P313C/A200C, F53C/K574C | |
| 0156 | A151 | BG505.SOSIP.R6.664.T332N_T128C/L165C/P313C/A200C/T51C/A578C | BG505 | SOSIP, R6, 664, T332N | T128C/L165C, P313C/A200C, T51C/A578C | |
| 0157 | A152 | BG505.SOSIP.R6.664.T332N_I573T | BG505 | SOSIP, R6, 664, T332N | I573T | destabilize gp41 helix bundle |
| 0158 | A153 | BG505.SOSIP.R6.664.T332N_G594N | BG505 | SOSIP, R6, 664, T332N | G594N | destabilize gp41 helix bundle |
| 0159 | A154 | BG505.SOSIP.R6.664.T332N_I573T-G594N | BG505 | SOSIP, R6, 664, T332N | I573T-G594N | destabilize gp41 helix bundle |
| 0160 | A155 | BG505.SOSIP.R6.664.T332N_I573T-G594N-K574E | BG505 | SOSIP, R6, 664, T332N | I573T-G594N-K574E | |
| 0161 | A156 | BG505.SOSIP.R6.664.T332N_I573T-G594N-K574T | BG505 | SOSIP, R6, 664, T332N | I573T-G594N-K574T | destabilize gp41 helix bundle |
| 0162 | A157 | BG505.SOSIP.R6.664.T332N_A433C_L122C | BG505 | SOSIP, R6, 664, T332N | A433C/L122C | |
| 0163 | A158 | BG505.SOSIP.R6.664.T332N_Q428C_E560C | BG505 | SOSIP, R6, 664, T332N | Q428C/E560C | |
| 0164 | A159 | BG505.SOSIP.R6.664.T332N_Q428C_A561C | BG505 | SOSIP, R6, 664, T332N | Q428C/A561C | |
| 0165 | A160 | BG505.SOSIP.R6.664.T332N_Q428C_Q562C | BG505 | SOSIP, R6, 664, T332N | Q428C/Q562C | |
| 0166 | A161 | BG505.SOSIP.R6.664.T332N_K574C_D107C | BG505 | SOSIP, R6, 664, T332N | K574C/D107C | |
| 0167 | A162 | BG505.SOSIP.R6.664.T332N_Q575C_Q550C | BG505 | SOSIP, R6, 664, T332N | Q575C/Q550C | |
| 0168 | A163 | BG505.SOSIP.R6.664.T332N_Q575C_Q551C | BG505 | SOSIP, R6, 664, T332N | Q575C/Q551C | |
| 0169 | A164 | BG505.SOSIP.R6.664.T332N_R579C_Q550C | BG505 | SOSIP, R6, 664, T332N | R579C/Q550C | |
| 0170 | A165 | BG505.SOSIP.R6.664.T332N_M426C_E370C | BG505 | SOSIP, R6, 664, T332N | M426C/E370C | |

| SEQ ID NO | Code | Name | Native Background | Mutations Compared to Native Background | Additional mutations | Comment |
|---|---|---|---|---|---|---|
| 0171 | A166 | BG505.SOSIP.R6.664.T332N_M426C_G380C | BG505 | SOSIP, R6, 664, T332N | M426C/G380C | CavF at trimer axis. Substitute- F, Y, L, M, V. stabilize prefusion axis interactions |
| 0172 | A167 | BG505.SOSIP.R6.664.T332N_T123W | BG505 | SOSIP, R6, 664, T332N | T123W | |
| 0173 | A168 | BG505.SOSIP.R6.664.T332N_I423W_I201W | BG505 | SOSIP, R6, 664, T332N | I423W, I201W | CavF at parallel b-strand #. Substitute- F, Y, L, M, V. prevent bridging sheet formation |
| 0174 | 0 | CH070.1 | CH070.1 | | | |
| 0175 | A169 | BG505.SOSIP.R6.664.T332N_K117W | BG505 | SOSIP, R6, 664, T332N | K117W | CavF at trimer axis. Substitute- F, Y, L, I, H, R, E, D, M, V. stabilize prefusion axis interactions |
| 0176 | A170 | BG505.SOSIP.R6.664.T332N_K117E | BG505 | SOSIP, R6, 664, T332N | K117E | CavF/charged at trimer axis. Substitute- F, Y, L, I, H, R, E, D, M, V. stabilize prefusion axis interactions |
| 0177 | A171 | BG505.SOSIP.R6.664.T332N_K121E | BG505 | SOSIP, R6, 664, T332N | K121E | CavF/charged at trimer axis. Substitute- F, Y, L, I, H, R, E, D, M, V. stabilize prefusion axis interactions |
| 0178 | A172 | BG505.SOSIP.R6.664.T332N_S110W | BG505 | SOSIP, R6, 664, T332N | S110W | CavF at trimer axis/gp41 interface boundary. Substitute- F, Y, L, I, M, V. stabilize prefusion axis interactions/gp41 interface/prevent helix movement |
| 0179 | A173 | BG505.SOSIP.R6.664.T332N_Q114W | BG505 | SOSIP, R6, 664, T332N | Q114W | Same as Seq_0178 |
| 0180 | A174 | BG505.SOSIP.R6.664.T332N_P220W | BG505 | SOSIP, R6, 664, T332N | P220W | CavF at gp41 interface. Substitute- F, Y, L, I, M, V. stabilize gp41 interface |
| 0181 | A175 | BG505.SOSIP.R6.664.T332N_T50W | BG505 | SOSIP, R6, 664, T332N | T50W | CavF at gp41 interface. Substitute- F, Y, L, I, M, V. stabilize gp41 interface |
| 0182 | A176 | BG505.SOSIP.R6.664.T332N_R429W | BG505 | SOSIP, R6, 664, T332N | R429W | CavF at parallel b-strand #. Substitute- F, Y, L, I, M, V. prevent bridging sheet formation |

-continued

| SEQ ID NO | Code | Name | Native Background | Mutations Compared to Native Background | Additional mutations | Comment |
|---|---|---|---|---|---|---|
| 0183 | A177 | BG505.SOSIP.R6.664.T332N_V120W_I201C_A433C | BG505 | SOSIP, R6, 664, T332N | V120W, I201C/A433C | ds/CavF under V1V2 cap. Substitute- F, Y, L, I, H, R, E, D, M, V. stabilize prefusion axis interactions/combined with DS |
| 0184 | A178 | BG505.SOSIP.R6.664.T332N_K121W_I201C_A433C | BG505 | SOSIP, R6, 664, T332N | K121W, I201C/A433C | ds/CavF at trimer axis. Substitute- F, Y, L, M, V. stabilize prefusion axis interactions/combined with DS |
| 0185 | A179 | BG505.SOSIP.R6.664.T332N_T123W_I201C_A433C | BG505 | SOSIP, R6, 664, T332N | T123W, I201C/A433C | Same as Seq_0184 |
| 0186 | A180 | BG505.SOSIP.R6.664.T332N_K117W_I201C_A433C | BG505 | SOSIP, R6, 664, T332N | K117W, I201C/A433C | ds/CavF at trimer axis. Substitute- F, Y, L, I, H, R, E, D,M,V. stabilize prefusion axis interactions/combined with DS |
| 0187 | A181 | BG505.SOSIP.R6.664.T332N_K117E_I201C_A433C | BG505 | SOSIP, R6, 664, T332N | K117E, I201C/A433C | ds/CavF/charged at trimer axis. Substitute- F, Y, L, I, H, R, E, D, M, V. stabilize prefusion axis interactions/combined with DS |
| 0188 | A182 | BG505.SOSIP.R6.664.T332N_K121E_I201C_A433C | BG505 | SOSIP, R6, 664, T332N | K121E, I201C/A433C | ds/CavF/charged at trimer axis. Substitute- F, Y, L, I, H, R, E, D, M, V. stabilize prefusion axis interactions/combined with DS |
| 0189 | A183 | BG505.SOSIP.R6.664.T332N_M426W_I201C_A433C | BG505 | SOSIP, R6, 664, T332N | M426W, I201C/A433C | ds/CavF at parallel b-strand #. Substitute- F, Y, L, I, H, R, E, D, V. stabilize prefusion axis interactions/combined with DS |
| 0190 | A184 | BG505.SOSIP.R6.664.T332N_S110W_I201C_A433C | BG505 | SOSIP, R6, 664, T332N | S110W, I201C/A433C | ds/CavF at trimer axis/gp41 interface boundary. Substitute- F, Y, L, I, M, V. stabilize prefusion axis interactions/gp41 interface/prevent helix movement/combined with DS |
| 0191 | A185 | BG505.SOSIP.R6.664.T332N_Q114W_I201C_A433C | BG505 | SOSIP, R6, 664, T332N | Q114W, I201C/A433C | Same as Seq_0190 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0192 | A186 | BG505.SOSIP.R6.664. T332N_P220W_I201C_A433C | BG505 | SOSIP, R6, 664, T332N | P220W, I201C/A433C | ds/CavF at gp41 interface. Substitute- F, Y, L, I, M, V. stabilize gp41 interface/ combined with DS |
| 0193 | A187 | BG505.SOSIP.R6.664. T332N_T50W_I201C_A433C | BG505 | SOSIP, R6, 664, T332N | T50W, I201C/A433C | ds/CavF at gp41 interface. Substitute- F, Y, L, I, M, V. stabilize gp41 interface/ combined with DS |
| 0194 | A188 | BG505.SOSIP.R6.664. T332N_R429W_I201C_A433C | BG505 | SOSIP, R6, 664, T332N | R429W, I201C/A433C | ds/CavF at parallel b-strand #. Substitute- F, Y, L, I, M, V. prevent bridging sheet formation/combined with DS |
| 0195 | A189 | BG505.SOSIP.R6.664.T332N_Y61W | BG505 | SOSIP, R6, 664, T332N | Y61W | CavF at Middle of $\alpha$-1. Will fill a cavity between gp120 and gp41 to prevent CD4 induced $\alpha$-1 disruption and $\alpha$0 formation |
| 0196 | A190 | BG505.SOSIP.R6.664. T332N_S209R_V68L | BG505 | SOSIP, R6, 664, T332N | S209R, V68L | CavF at Loop between $\alpha$-1 and beta 0 and loop between beta 3 and beta 4. Substitute- F, W, Y, L, I, M, V. Fills cavities that are otherwise filled by CD4 induced $\alpha$0 formation |
| 0197 | A191 | BG505.SOSIP.R6.664. T332N_F53W_Q246W | BG505 | SOSIP, R6, 664, T332N | F53W, Q246W | CavF at gp120-gp41 interface, N-term of beta-2, middle of beta-8, Substitute- 246 F, W, Y, L, I, M, V. Will fill a cavity between gp120 and gp41 to stabilize gp41 disordered region and interaction between gp120 and gp41 |
| 0198 | A192 | BG505.SOSIP.R6.664. T332N_Y177W_I323F | BG505 | SOSIP, R6, 664, T332N | Y177W, I323F | CavF at C-term of beta C, C-term of beta V3B. Substitute- 323 F, Y, W. Fills cavity between V3 and gp120 core to stabilize closed cap |
| 0199 | A193 | BG505SOS.R6.664.T332N_G41C A541C | BG505 | SOS, R6, 664, T332N | G41C/A541C | DS- Fixes ground state, DS between gp120 and gp41 |
| 0200 | A194 | BG505.SOSIP.R6.664.T332N_G41C A541C | BG505 | SOSIP, R6, 664, T332N | G41C/A541C | DS- Fixes ground state, DS between gp120 and gp41 |

| 1 SEQ ID NO | 2 Code | 3 Name | 4 Native Background | 5 Mutations Compared to Native Background | 6 Additional mutations | 7 Comment |
|---|---|---|---|---|---|---|
| 0201 | A195 | BG505.R6.664.T332N_G41C_A541C | BG505 | R6, 664, T332N | G41C/A541C | DS, non SOSIP- Fixes ground state, DS between gp120 and gp41 |
| 0202 | A196 | BG505,SOS.R6.664.T332N_547-GGPGPGG-569 | BG505 | SOS, R6, 664, T332N | 547-GGPGPGG-569 | Prevent α6 to α7 transition |
| 0203 | A197 | BG505,SOS.R6.664.T332N_547-GGGGPGPG-569 | BG505 | SOS, R6, 664, T332N | 547-GGGGPGPG-569 | Prevent α6 to α7 transition |
| 0204 | A198 | BG505,SOS.R6.664.T332N_547-GGGPGGG-569 | BG505 | SOS, R6, 664, T332N | 547-GGGPGGG-569 | Prevent α6 to α7 transition |
| 0205 | A199 | BG505,SOS.R6.664.T332N_547-GGPGGGPGG-569 | BG505 | SOS, R6, 664, T332N | 547-GGPGGGPGG-569 | Prevent α6 to α7 transition |
| 0206 | A200 | BG505.SOSIP.R6.664.T332N_Q551P | BG505 | SOSIP, R6, 664, T332N | Q551P | Prevent α6 to α7 transition |
| 0207 | A201 | BG505.SOSIP.R6.664.T332N_L556P | BG505 | SOSIP, R6, 664, T332N | L556P | Prevent α6 to α7 transition |
| 0208 | A202 | BG505.SOSIP.R6.664.T332N_H564P | BG505 | SOSIP, R6, 664, T332N | H564P | Prevent α6 to α7 transition |
| 0209 | A203 | BG505.SOSIP.R6.664.T332N_L568P | BG505 | SOSIP, R6, 664, T332N | L568P | Prevent α6 to α7 transition |
| 0210 | B001 | BG505.IP.664.T332N_bC-10ln | BG505 | IP, 664, T332N, | 508 (REKR) 511 → 10 A.A. linker | Single chain; no SOS; with I559P |
| 0211 | B002 | BG505.IP.664.T332N_bC-10ln_R166W | BG505 | IP, 664, T332N | 508 (REKR) 511 replaced by 10 A.A. linker, R166W | Single chain; no SOS; with I559P; with R166W |
| 0212 | B003 | BG505.IP.664.T332N_bC-11ln | BG505 | IP, 664, T332N | 508 (REKR) 511 → 11 A.A. linker | Single chain; no SOS; with I559P |
| 0213 | B004 | BG505.IP.664.T332N_bC-11ln_R166W | BG505 | IP, 664, T332N | 508 (REKR) 511 → 11 A.A. linker, R166W | Same as Seq_211 |
| 0214 | B005 | BG505.IP.664.T332N_bC-12ln | BG505 | IP, 664, T332N | 508 (REKR) 511 → 12 A.A. linker | Single chain; no SOS; with I559P |
| 0215 | B006 | BG505.IP.664.T332N_bC-12ln_R166W | BG505 | IP, 664, T332N | 508 (REKR) 511 → 12 A.A. linker, R166W | Same as Seq_211 |
| 0216 | B007 | BG505.IP.664.T332N_bC-13ln | BG505 | IP, 664, T332N | 508 (REKR) 511 → 13 A.A. linker | Single chain; no SOS; with I559P |
| 0217 | B008 | BG505.IP.664.T332N_bC-13ln_R166W | BG505 | IP, 664, T332N | 508 (REKR) 511 → 13 A.A. linker, R166W | Same as Seq_211 |
| 0218 | B009 | BG505.IP.664.T332N_bC-14ln | BG505 | IP, 664, T332N | 508 (REKR) 511 → 14 A.A. linker | Single chain; no SOS; with I559P |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0219 | B010 | BG505,IP.664.T332N_bC-14ln_R166W | BG505 | IP, 664, T332N | 508(REKR)511 → 14 A.A. linker, R166W | Same as Seq_211 |
| 0220 | B011 | BG505,IP.664.T332N_bC-15ln | BG505 | IP, 664, T332N | 508(REKR)511 → 15 A.A. linker | Single chain; no SOS; with I559P |
| 0221 | B012 | BG505,IP.664.T332N_bC-15ln_R166W | BG505 | IP, 664, T332N | 508(REKR)511 → 15 A.A. linker, R166W | Same as Seq_211 |
| 0222 | B013 | BG505,IP.664.T332N_bC-1ln | BG505 | IP, 664, T332N | 508(REKR)511 → 1 A.A. linker | Single chain; no SOS; with I559P |
| 0223 | B014 | BG505,IP.664.T332N_bC-1ln_R166W | BG505 | IP, 664, T332N | 508(REKR)511 → 1 A.A. linker, R166W | Same as Seq_211 |
| 0224 | B015 | BG505,IP.664.T332N_bC-20ln | BG505 | IP, 664, T332N | 508(REKR)511 → 20 A.A. linker | Single chain; no SOS; with I559P |
| 0225 | B016 | BG505,IP.664.T332N_bC-20ln_R166W | BG505 | IP, 664, T332N | 508(REKR)511 → 20 A.A. linker, R166W | Same as Seq_211 |
| 0226 | B017 | BG505,IP.664.T332N_bC-2ln | BG505 | IP, 664, T332N | 508(REKR)511 → 2 A.A. linker | Single chain; no SOS; with I559P |
| 0227 | B018 | BG505,IP.664.T332N_bC-2ln_R166W | BG505 | IP, 664, T332N | 508(REKR)511 → 2 A.A. linker, R166W | Same as Seq_211 |
| 0228 | B019 | BG505,IP.664.T332N_bC-3ln | BG505 | IP, 664, T332N | 508(REKR)511 → 3 A.A. linker | Single chain; no SOS; with I559P |
| 0229 | B020 | BG505,IP.664.T332N_bC-3ln_R166W | BG505 | IP, 664, T332N | 508(REKR)511 → 3 A.A. linker, R166W | Same as Seq_211 |
| 0230 | B021 | BG505,IP.664.T332N_bC-4ln | BG505 | IP, 664, T332N | 508(REKR)511 replaced by 4 A.A. linker | Single chain; no SOS; with I559P |
| 0231 | B022 | BG505,IP.664.T332N_bC-4ln_R166W | BG505 | IP, 664, T332N | 508(REKR)511 → 4 A.A. linker, R166W | Same as Seq_211 |
| 0232 | B023 | BG505,IP.664.T332N_bC-5ln | BG505 | IP, 664, T332N | 508(REKR)511 → 5 A.A. linker | Single chain; no SOS; with I559P |
| 0233 | B024 | BG505,IP.664.T332N_bC-5ln_R166W | BG505 | IP, 664, T332N | 508(REKR)511 → 5 A.A. linker, R166W | Same as Seq_211 |
| 0234 | B025 | BG505,IP.664.T332N_bC-6ln | BG505 | IP, 664, T332N | 508(REKR)511 → 6 A.A. linker | Single chain; no SOS; with I559P |

-continued

| SEQ ID NO | Code | Name | Native Background | Mutations Compared to Native Background | Additional mutations | Comment |
|---|---|---|---|---|---|---|
| 0235 | B026 | BG505.IP.664.T332N_bC-6ln_R166W | BG505 | IP, 664, T332N | 508(REKR) 511 → 6 A.A. linker, R166W | Same as Seq_211 |
| 0236 | B027 | BG505.IP.664.T332N_bC-7ln | BG505 | IP, 664, T332N | 508(REKR) 511 → 7 A.A. linker | Single chain; no SOS; with I559P |
| 0237 | B028 | BG505.IP.664.T332N_bC-7ln_R166W | BG505 | IP, 664, T332N | 508(REKR) 511 → 7 A.A. linker, R166W | Same as Seq_211 |
| 0238 | B029 | BG505.IP.664.T332N_bC-8ln | BG505 | IP, 664, T332N | 508(REKR) 511 → 8 A.A. linker | Single chain; no SOS; with I559P |
| 0239 | B030 | BG505.IP.664.T332N_bC-8ln_R166W | BG505 | IP, 664, T332N | 508(REKR) 511 → 8 A.A. linker, R166W | Same as Seq_211 |
| 0240 | B031 | BG505.IP.664.T332N_bC-9ln | BG505 | IP, 664, T332N | 508(REKR) 511 → 9 A.A. linker | Single chain; no SOS; with I559P |
| 0241 | B032 | BG505.IP.664.T332N_bC-9ln_R166W | BG505 | IP, 664, T332N | 508(REKR) 511 → 9 A.A. linker, R166W | Same as Seq_211 |
| 0242 | B033 | BG505.664.T332N_C-10ln | BG505 | 664, T332N | 508(REKR) 511 → 10 A.A. linker | Single chain; no SOSIP |
| 0243 | B034 | BG505.664.T332N_C-10ln_Q551F | BG505 | 664, T332N | 508(REKR) 511 → 10 A.A. linker; Q551F | Single chain; no SOS; with Q551F |
| 0244 | B035 | BG505.664.T332N_C-11ln | BG505 | 664, T332N | 508(REKR) 511 → 11 A.A. linker | Single chain; no SOSIP |
| 0245 | B036 | BG505.664.T332N_C-12ln | BG505 | 664, T332N | 508(REKR) 511 → 12 A.A. linker | Single chain; no SOSIP |
| 0246 | B037 | BG505.664.T332N_C-13ln | BG505 | 664, T332N | 508(REKR) 511 → 13 A.A. linker | Single chain; no SOSIP |
| 0247 | B038 | BG505.664.T332N_C-14ln | BG505 | 664, T332N | 508(REKR) 511 → 14 A.A. linker | Single chain; no SOSIP |
| 0248 | B039 | BG505.664.T332N_C-15ln | BG505 | 664, T332N | 508(REKR) 511 → 15 A.A. linker | Single chain; no SOSIP |
| 0249 | B040 | BG505.664.T332N_C-1ln | BG505 | 664, T332N | 508(REKR) 511 → 1 A.A. linker | Single chain; no SOSIP |
| 0250 | B041 | BG505.664.T332N_C-2ln | BG505 | 664, T332N | 508(REKR) 511 → 2 A.A. linker | Single chain; no SOSIP |

-continued

| SEQ ID NO | Code | Name | Native Background | Mutations Compared to Native Background | Additional mutations | Comment |
|---|---|---|---|---|---|---|
| 0251 | B042 | BG505.664.T332N_C-3ln | BG505 | 664, T332N | 508(REKR) 511 → 3 A.A. linker | Single chain; no SOSIP |
| 0252 | B043 | BG505.664.T332N_C-4ln | BG505 | 664, T332N | 508(REKR) 511 → 4 A.A. linker | Single chain; no SOSIP |
| 0253 | B044 | BG505.664.T332N_C-5ln | BG505 | 664, T332N | 508(REKR) 511 → 5 A.A. linker | Single chain; no SOSIP |
| 0254 | B045 | BG505.664.T332N_C-6ln | BG505 | 664, T332N | 508(REKR) 511 → 6 A.A. linker | Single chain; no SOSIP |
| 0255 | B046 | BG505.664.T332N_C-7ln | BG505 | 664, T332N | 508(REKR) 511 → 7 A.A. linker | Single chain; no SOSIP |
| 0256 | B047 | BG505.664.T332N_C-8ln | BG505 | 664, T332N | 508(REKR) 511 → 8 A.A. linker | Single chain; no SOSIP |
| 0257 | B048 | BG505.664.T332N_C-9ln | BG505 | 664, T332N | 508(REKR) 511 → 9 A.A. linker | Single chain; no SOSIP |
| 0258 | B049 | BG505.IP.664.T332N_Gp120-HR2-HR1 | BG505 | IP, 664, T332N | | circular permutant single chain |
| 0259 | B050 | BG505.IP.664.T332N_Gp120-Linker-HR1-GCN4 | BG505 | IP, 664, T332N | | circular permutant single chain linker gp120-HR1 |
| 0260 | B051 | BG505.IP.664.T332N_SOScircuit2noC | BG505 | IP, 664, T332N | | circular permutant single chain |
| 0261 | B052 | BG505.IP.664.T332N_SOScircuit3-noFus | BG505 | IP, 664, T332N | | circular permutant single chain |
| 0262 | B053 | BG505.IP.664.T332N_SOScircuit4noC-noFus | BG505 | IP, 664, T332N | | circular permutant single chain |
| 0263 | B054 | BG505.IP.664.T332N_SOScircuit9-GCN4coredownCC | BG505 | IP, 664, T332N | | circular permutant single chain |
| 0264 | B055 | BG505.IP.664.T332N_SOScircuit14-HR1envHR2-GCN4coredown | BG505 | IP, 664, T332N | | circular permutant single chain |
| 0265 | B056 | BG505.IP.664.T332N_SOScircuit15-HR1envHR2-GCN4coredown | BG505 | IP, 664, T332N | | circular permutant single chain |
| 0266 | B057 | BG505.IP.664.T332N_SOScircuit16-HR1envHR2-GCN4coredown | BG505 | IP, 664, T332N | | circular permutant single chain |
| 0267 | B058 | BG505.IP.664.T332N_SOScircuit17-HR1envHR2 | BG505 | IP, 664, T332N | | circular permutant single chain |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0268 | B059 | BG505.IP.664.T332N_SOScircuit18-HR1envHR2 | BG505 | IP, 664, T332N | | circular permutant single chain |
| 0269 | B060 | BG505.IP.664.T332N_SOScircuit4noC-noFus_CMVR-3c-His-R166W | BG505 | IP, 664, T332N | | circular permutant single chain |
| 0270 | B061 | BG505.IP.664.T332N_1.ZM53.R166W | BG505 | IP, 664, T332N | R166W, circ. permut. | circ. Permut. single chain in ZM53, with R166W |
| 0271 | B062 | BG505.IP.664.T332N_10.ZM53.R166W | BG505 | IP, 664, T332N | R166W, circ. permut. | circ. Permut. single chain in ZM53, with R166W |
| 0272 | B063 | BG505.IP.664.T332N_10_BG505_Nterm_H1 | BG505 | IP, 664, T332N | circ. permut. | circular permutant single chain |
| 0273 | B064 | BG505.IP.664.T332N_10_BG505_Nterm_H1_P313W | BG505 | IP, 664, T332N | P313W, circ. permut. | circular permutant single chain |
| 0274 | B065 | BG505.IP.664.T332N_10_BG505_Nterm_H1_P313W-R166W | BG505 | IP, 664, T332N | P313W, R166W, circ. permut. | circular permutant single chain |
| 0275 | B066 | BG505.IP.664.T332N_10_BG505_Nterm_H1_R166W | BG505 | IP, 664, T332N | R166W, circ. permut. | circular permutant single chain |
| 0276 | B067 | BG505.IP.664.T332N_11.ZM53.R166W | BG505 | IP, 664, T332N | R166W, circ. permut. | circular permutant single chain |
| 0277 | B068 | BG505.IP.664.T332N_11_BG505_Nterm_H1 | BG505 | IP, 664, T332N | circ. permut. | circular permutant single chain |
| 0278 | B069 | BG505.IP.664.T332N_11_BG505_Nterm_H1_P313W | BG505 | IP, 664, T332N | P313W, circ. permut. | circular permutant single chain |
| 0279 | B070 | BG505.IP.664.T332N_11_BG505_Nterm_H1_P313W-R166W | BG505 | IP, 664, T332N | P313W, R166W, circ. permut. | circular permutant single chain |
| 0280 | B071 | BG505.IP.664.T332N_11_BG505_Nterm_H1_R166W | BG505 | IP, 664, T332N | R166W, circ. permut. | circular permutant single chain |
| 0281 | B072 | BG505.IP.664.T332N_12.ZM53.R166W | BG505 | IP, 664, T332N | R166W, circ. permut. | circular permutant single chain |
| 0282 | B073 | BG505.IP.664.T332N_12_BG505_Nterm_H1 | BG505 | IP, 664, T332N | circ. permut. | circular permutant single chain |
| 0283 | B074 | BG505.IP.664.T332N_12_BG505_Nterm_H1_P313W | BG505 | IP, 664, T332N | P313W, circ. permut. | circular permutant single chain |
| 0284 | B075 | BG505.IP.664.T332N_12_BG505_Nterm_H1_P313W-R166W | BG505 | IP, 664, T332N | P313W, R166W, circ. permut. | circular permutant single chain |
| 0285 | B076 | BG505.IP.664.T332N_12_BG505_Nterm_H1_R166W | BG505 | IP, 664, T332N | R166W, circ. permut. | circular permutant single chain |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0286 | B077 | BG505.IP.664.T332N_13_BG505_6RLinked | BG505 | IP, 664, T332N | Linker at cleavage site | |
| 0287 | B078 | BG505.IP.664.T332N_14_BG505_6RLinked | BG505 | IP, 664, T332N | Linker at cleavage site | |
| 0288 | B079 | BG505.IP.664.T332N_15_BG505_6RLinked | BG505 | IP, 664, T332N | Linker at cleavage site | |
| 0289 | B080 | BG505.IP.664.T332N_16_BG505_6RLinked | BG505 | IP, 664, T332N | Linker at cleavage site | |
| 0290 | B081 | BG505.IP.664.T332N_1_BG505_Nterm_H1 | BG505 | IP, 664, T332N | circ. permut. | circular permutant single chain |
| 0291 | B082 | BG505.IP.664.T332N_1_BG505_Nterm_H1_R166W | BG505 | IP, 664, T332N | R166W, circ. permut. | circular permutant single chain |
| 0292 | B083 | BG505.IP.664.T332N_2_BG505_Nterm_H1 | BG505 | IP, 664, T332N | circ. permut. | circular permutant single chain |
| 0293 | B084 | BG505.IP.664.T332N_3_BG505_Nterm_H1 | BG505 | IP, 664, T332N | circ. permut. | circular permutant single chain |
| 0294 | B085 | BG505.IP.664.T332N_4.ZM53.R166W | BG505 | IP, 664, T332N | R166W, circ. permut. | circular permutant single chain in ZM53, with R166W |
| 0295 | B086 | BG505.IP.664.T332N_4_BG505_Nterm_H1 | BG505 | IP, 664, T332N | circ. permut. | Circular permutant single chain |
| 0296 | B087 | BG505.IP.664.T332N_4_BG505_Nterm_H1_R166W | BG505 | IP, 664, T332N | R166W, circ. permut. | circular permutant single chain, with R166W |
| 0297 | B088 | BG505.IP.664.T332N_5_BG505_Nterm_H1 | BG505 | IP, 664, T332N | circ. permut. | Circular permutant single chain |
| 0298 | B089 | BG505.IP.664.T332N_6_BG505_Nterm_H1 | BG505 | IP, 664, T332N | circ. permut. | Circular permutant single chain |
| 0299 | B090 | BG505.IP.664.T332N_7_BG505_Nterm_H1 | BG505 | IP, 664, T332N | circ. permut. | Circular permutant single chain |
| 0300 | B091 | BG505.IP.664.T332N_7_BG505_Nterm_H1_R166W | BG505 | IP, 664, T332N | R166Wcirc. permut. | circular permutant single chain, with R166W |
| 0301 | B092 | BG505.IP.664.T332N_8_BG505_Nterm_H1 | BG505 | IP, 664, T332N | circ. permut. | Circular permutant single chain |
| 0302 | B093 | BG505.IP.664.T332N_9_BG505_Nterm_H1 | BG505 | IP, 664, T332N | circ. permut. | Circular permutant single chain |
| 0303 | B094 | BG505.SOSIP.664.T332N_29_gp120-HR2_A433P | BG505 | SOSIP, 664, T332N | A433P, circ. permut. | circular permutant single chain, with A433P |
| 0304 | B095 | BG505.SOSIP.664.T332N_30_gp120-HR2_A433P | BG505 | SOSIP, 664, T332N | A433P, circ. permut. | circular permutant single chain, with A433P |
| 0305 | B096 | CH117.4_332N_IP_10ln | CH117.4 | IP; 664; T332N | 508 (REKR) 511 → 10 A.A. linker; 332N | Single chain; no SOS; with I559P |

-continued

| SEQ ID NO | Code | Name | Native Background | Mutations Compared to Native Background | Additional mutations | Comment |
|---|---|---|---|---|---|---|
| 0306 | B097 | CNE58_IP_10ln | CNE58 | IP; 664 | 508(REKR) 511 → 10 A.A. linker | Single chain; no SOS; with I559P |
| 0307 | B098 | Cap256-SU_IP_10ln | Cap256-SU | IP; 664 | Same as Seq_307 | Single chain; no SOS; with I559P |
| 0308 | B099 | SHIV-1157ipd3N4_IP_10ln | 1157ipd3N4 | IP; 664 | Same as Seq_307 | Single chain; no SOS; with I559P |
| 0309 | B100 | ZM53_IP_10ln | ZM53 | IP; 664 | Same as Seq_307 | Single chain; no SOS; with I559P |
| 0310 | B101 | C-10ln_Q551F | BG505 | 664 | 664; 508(REKR) 511 → 10 A.A. linker; Q551F | Single chain; no SOS; with I559P; with Q551F |
| 0311 | B102 | TF-B_THRO_TF1_10ln_Q551F | THRO_TF1 | 664 | 664; 508(REKR) 511 → 10 A.A. linker; Q551F | Single chain; no SOS; with Q551F |
| 0312 | B103 | TF-C_1245045_10ln_Q551F | 1245045 | 664 | 664; 508(REKR) 511 → 10 A.A. linker; Q551F | Single chain; no SOS; with Q551F |
| 0313 | B104 | 3301_V1_C24_10ln_Q551F | 3301_V1_C24 | 664 | 664; 508(REKR) 511 → 10 A.A. linker; Q551F | Single chain; no SOS; with Q551F |
| 0314 | B105 | TF-C_19157834_v1_10ln_Q551F_P162T | 19157834_v1 | 664 | 664; 508(REKR) 511 → 10 A.A. linker; Q551F; P162TQ551F | Single chain; no SOS; with Q551F |
| 0315 | B106 | 25925-2.22_10ln_Q551F | 25925-2.22 | IP; 664 | 508(REKR) 511 → 10 A.A. linker; Q551F | Single chain; no SOS; with Q551F |
| 0316 | B107 | CAP210.E8_10ln_Q551F | CAP210.E8 | IP; 664 | 508(REKR) 511 → 10 A.A. linker; Q551F | Single chain; no SOS; with Q551F |
| 0317 | B108 | CNE58_IP_10ln_SU-strandC | CNE58 | IP; 664 | 508(REKR) 511 → 10 A.A. linker | Single chain; no SOS; with I559P; strand-C from CAP256-SU |
| 0318 | B109 | CNE58_10ln_Q551F_SU-strandC | CNE58 | IP; 664 | 508(REKR) 511 → 10 A.A. linker; Q551F | Single chain; no SOS; with Q551F; strand-C from CAP256-SU |
| 0319 | B110 | TF-B_THRO_TF1_IP_10ln | THRO_TF1 | IP; 664 | Same as Seq_307 | Single chain; no SOS; with I559P |
| 0320 | B111 | 25925-2.22_IP_10ln | 25925-2.22 | IP; 664 | 508(REKR) 511 → 10 A.A. linker | Single chain; no SOS; with I559P |
| 0321 | B112 | CAP210.E8_IP_10ln | CAP210.E8 | IP; 664 | 508(REKR) 511 → 10 A.A. linker | Single chain; no SOS; with I559P |

| SEQ ID NO | Code | Name | Native Background | Mutations Compared to Native Background | Additional mutations | Comment |
|---|---|---|---|---|---|---|
| 0322 | B113 | TF-C_19157834_v1_IP_10ln_P162T | 19157834_v1 | IP; 664 | 508(REKR)511 → 10 A.A. linker, P162T | Single chain; no SOS; with I559P |
| 0323 | B114 | 3301_V1_C24_IP_10ln | 3301_V1_C24 | IP; 664 | 508(REKR)511 → 10 A.A. linker | Single chain; no SOS; with I559P |
| 0324 | B115 | TF-C_1245045_IP_10ln | 1245045 | IP; 664 | 508(REKR)511 → 10 A.A. linker | Single chain; no SOS; with I559P |
| 0325 | B116 | 00836-2.5_332N_IP_10ln | 00836-2.5 | IP; 664 | 508(REKR)511 → 10 A.A. linker, 332N | Single chain; no SOS; with I559P |
| 0326 | B117 | 6322_V4_C1_332N_IP_10ln | 6322_V4_C1 | IP; 664 | 508(REKR)511 → 10 A.A. linker, 332N | Single chain; no SOS; with I559P |
| 0327 | B118 | ZM53-R166W_bC-10ln_IP | ZM53 | IP; 664 | 508(REKR)511 → 10 A.A. linker, R166W | Single chain; no SOS; with I559P |
| 0328 | B119 | ZM53-R166W_bC-15ln_IP | ZM53 | IP; 664 | 508(REKR)511 → 15 A.A. linker, R166W | Single chain; no SOS; with I559P |
| 0329 | B120 | ZM53-R166W_bC-20ln_IP | ZM53 | IP; 664 | 508(REKR)511 → 20 A.A. linker, R166W | Single chain; no SOS; with I559P |
| 0330 | B121 | ZM53-R166W_bC-7ln_IP | ZM53 | IP; 664 | 508(REKR)511 → 7 A.A. linker, R166W | Single chain; no SOS; with I559P |
| 0331 | B122 | ZM53-R166W_C-10ln | ZM53 | 664 | 508(REKR)511 → 10 A.A. linker | Single chain; no SOS |
| 0332 | B123 | ZM53-R166W_C-15ln | ZM53 | 664 | 508(REKR)511 → 15 A.A. linker | Single chain; no SOS |
| 0333 | B124 | ZM53-R166W_C-20ln | ZM53 | 664 | 508(REKR)511 → 20 A.A. linker | Single chain; no SOS |
| 0334 | B125 | ZM53-R166W_C-7ln | ZM53 | 664 | 508(REKR)511 → 7 A.A. linker | Single chain; no SOS |
| 0335 | B126 | BG505.SOSIP.664.T332N_del504-518l5ln | BG505 | SOSIP, 664, T332N | 504-518 → 5 A.A. linker | Single chain + N-term of gp41; with SOS; with I559P |
| 0336 | B127 | BG505.SOSIP.664.T332N_del504-518_10ln | BG505 | SOSIP, 664, T332N | 504-518 → 10 A.A. linker | Same as Seq_0335 |
| 0337 | B128 | BG505.SOSIP.664.T332N_del504-518_15ln | BG505 | SOSIP, 664, T332N | segment 504-518 → 15 A.A. linker | Same as Seq_0335 |
| 0338 | B129 | BG505.SOSIP.664.T332N_del504-518_20ln | BG505 | SOSIP, 664, T332N | segment 504-518 → 20 A.A. linker | Same as Seq_0335 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0339 | B130 | BG505.SOSIP.664.T332N_del505-518_5ln | BG505 | SOSIP, 664, T332N | segment 505-518 → 5 A.A. linker | Same as Seq_0335 |
| 0340 | B131 | BG505.SOSIP.664.T332N_del505-518_10ln | BG505 | SOSIP, 664, T332N | segment 505-518 → 10 A.A. linker | Same as Seq_0335 |
| 0341 | B132 | BG505.SOSIP.664.T332N_del505-518_15ln | BG505 | SOSIP, 664, T332N | segment 505-518 → 15 A.A. linker | Same as Seq_0335 |
| 0342 | B133 | BG505.SOSIP.664.T332N_del505-518_20ln | BG505 | SOSIP, 664, T332N | segment 505-518 → 20 A.A. linker | Same as Seq_0335 |
| 0343 | B134 | BG505.SOSIP.664.T332N_del504-521_5ln | BG505 | SOSIP, 664, T332N | segment 504-521 → 5 A.A. linker | Same as Seq_0335 |
| 0344 | B135 | BG505.SOSIP.664.T332N_del504-521_10ln | BG505 | SOSIP, 664, T332N | segment 504-521 → 10 A.A. linker | Same as Seq_0335 |
| 0345 | B136 | BG505.SOSIP.664.T332N_del504-521_15ln | BG505 | SOSIP, 664, T332N | segment 504-521 → 15 A.A. linker | Same as Seq_0335 |
| 0346 | B137 | BG505.SOSIP.664.T332N_del504-521_20ln | BG505 | SOSIP, 664, T332N | segment 504-521 → 20 A.A. linker | Same as Seq_0335 |
| 0347 | B138 | BG505.SOSIP.664.T332N_del505-521_5ln | BG505 | SOSIP, 664, T332N | segment 505-521 → 5 A.A. linker | Same as Seq_0335 |
| 0348 | B139 | BG505.SOSIP.664.T332N_del505-521_10ln | BG505 | SOSIP, 664, T332N | segment 505-521 → 10 A.A. linker | Same as Seq_0335 |
| 0349 | B140 | BG505.SOSIP.664.T332N_del505-521_15ln | BG505 | SOSIP, 664, T332N | segment 505-521 → 15 A.A. linker | Same as Seq_0335 |
| 0350 | B141 | BG505.SOSIP.664.T332N_del505-521_20ln | BG505 | SOSIP, 664, T332N | segment 505-521 → 20 A.A. linker | Same as Seq_0335 |
| 0351 | B142 | BG505.SOSIP.664.T332N_c5ln | BG505 | SOSIP, 664, T332N | 508 (REKR) 511 → 5 A.A. linker | Same as Seq_0335 |
| 0352 | B143 | BG505.SOSIP.664.T332N_c10ln | BG505 | SOSIP, 664, T332N | 508 (REKR) 511 → 10 A.A. linker | Same as Seq_0335 |
| 0353 | B144 | BG505.SOSIP.664.T332N_c15ln | BG505 | SOSIP, 664, T332N | 508 (REKR) 511 → 15 A.A. linker | Same as Seq_0335 |
| 0354 | B145 | BG505.SOSIP.664.T332N_c20ln | BG505 | SOSIP, 664, T332N | 508 (REKR) 511 → 20 A.A. linker | Same as Seq_0335 |

-continued

| SEQ ID NO | Code | Name | Native Background | Mutations Compared to Native Background | Additional mutations | Comment |
|---|---|---|---|---|---|---|
| 0355 | B146 | BG505.1P.664.T332N_del505-521_5ln | BG505 | IP,664, T332N | segment 505-521 → 5 A.A. linker | Single chain + N-term of gp41; no SOS; with I559P |
| 0356 | B147 | BG505.1P.664.T332N_del505-521_10ln | BG505 | IP,664, T332N | segment 505-521 → 10 A.A. linker | Single chain + N-term of gp41; no SOS; with I559P |
| 0357 | B148 | BG505.1P.664.T332N_del505-521_15ln | BG505 | IP,664, T332N | segment 505-521 → 15 A.A. linker | Single chain + N-term of gp41; no SOS; with I559P |
| 0358 | B149 | BG505.1P.664.T332N_del505-521_20ln | BG505 | IP,664, T332N | segment 505-521 → 20 A.A. linker | Single chain + N-term of gp41; no SOS; with I559P |
| 0359 | B150 | BG505.SOSIP.664.T332N_sc BZ1 | BG505 | SOSIP, 664, T332N | cleavage site and NT of fusion peptide replaced by a flexible linker | |
| 0360 | B151 | BG505.SOSIP.664.T332N_sc BZ2 | BG505 | SOSIP, 664, T332N | Same as Seq_0359 | Same as Seq_0335 |
| 0361 | B152 | BG505.SOSIP.664.T332N_sc BZ3 | BG505 | SOSIP, 664, T332N | Same as Seq_0359 | Same as Seq_0335 |
| 0362 | B153 | BG505.SOSIP.664.T332N_sc BZ4 | BG505 | SOSIP, 664, T332N | Same as Seq_0359 | Same as Seq_0335 |
| 0363 | B154 | BG505.SOSIP.664.T332N_sc BZ5 | BG505 | SOSIP, 664, T332N | Same as Seq_0359 | Same as Seq_0335 |
| 0364 | B155 | BG505.SOSIP.664.T332N_sc BZ6 | BG505 | SOSIP, 664, T332N | Same as Seq_0359 | Same as Seq_0335 |
| 0365 | B156 | BG505.SOSIP.664.T332N_sc BZ7 | BG505 | SOSIP, 664, T332N | Same as Seq_0359 | Same as Seq_0335 |
| 0366 | B157 | BG505.SOSIP.664.T332N_sc BZ8 | BG505 | SOSIP, 664, T332N | Same as Seq_0359 | Same as Seq_0335 |
| 0367 | B158 | BG505.SOSIP.664.T332N_sc BZ9 | BG505 | SOSIP, 664, T332N | Same as Seq_0359 | Same as Seq_0335 |
| 0368 | B159 | BG505.SOSIP.664.T332N_sc BZ10 | BG505 | SOSIP, 664, T332N | Same as Seq_0359 | Same as Seq_0335 |
| 0369 | B160 | BG505.SOSIP.664.T332N_sc BZ11 | BG505 | SOSIP, 664, T332N | Same as Seq_0359 | Same as Seq_0335 |
| 0370 | B161 | BG505.SOSIP.664.T332N_sc BZ12 | BG505 | SOSIP, 664, T332N | Same as Seq_0359 | Same as Seq_0335 |
| 0371 | B162 | BG505.SOSIP.664.T332N_sc BZ2 G312C/S199C/R166C/V127C | BG505 | SOSIP, 664, T332N | cleavage site and NT of fusion peptide replaced by a flexible linker; G312C/S199C/R166C/V127C | Same as Seq_0335 |
| 0372 | B163 | BG505.SOSIP.664.T332N_sc BZ3 G312C/S199C/R166C/V127C | BG505 | SOSIP, 664, T332N | cleavage site and NT of fusion peptide replaced by a flexible linker; G312C/S199C/R166C/V127C | Same as Seq_0335 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0373 | B164 | BG505.IP.664.T332N_bC10ln-5ln-HpyFerritin | BG505 | IP, 664, T332N | on ferritin with a 5-linker | ferritin for linker replacement of gp120-gp41 cleavage site; no SOS; with I559P |
| 0374 | B165 | BG505.IP.664.T332N_bC10ln-10ln-HpyFerritin | BG505 | IP, 664, T332N | on ferritin with a 10-linker | Same as Seq_0373 |
| 0375 | B166 | BG505.IP.664.T332N_bC10ln-15ln-HpyFerritin | BG505 | IP, 664, T332N | on ferritin with a 15-linker | Same as Seq_0373 |
| 0376 | B167 | BG505.664.T332N_FC10ln-5ln-HpyFerritin | BG505 | 664, T332N | on ferritin with a 5-linker; Q551F | ferritin for linker replacement of gp120-gp41 cleavage site; no SOS; with Q551F |
| 0377 | B168 | BG505.664.T332N_FC10ln-10ln-HpyFerritin | BG505 | 664, T332N | on ferritin with a 10-linker; Q551F | Same as Seq_0376 |
| 0378 | B169 | BG505.664.T332N_FC10ln-15ln-HpyFerritin | BG505 | 664, T332N | on ferritin with a 15-linker; Q551F | Same as Seq_0376 |
| 0379 | H009 | Cap256-SU_bg505-NCgp120 + gp41.SOSIP | Cap256-SU/BG505 chimera | SOSIP; 664; R6 | BG505 Platform, remainder = Cap256-SU | |
| 0380 | H010 | 1157ipd3N4_bg505-NCgp120 + gp41.SOSIP | 1157ipd3N4/BG505 chimera | SOSIP; 664; R6 | BG505 Platform, remainder = 1157ipd3N4 | |
| 0381 | H011 | CH117.4_332N_bg505-NCgp120 + gp41.SOSIP | CH117.4_332N/BG505 chimera | SOSIP; 664; R6 | BG505 Platform, remainder = CH117.4_332N | |
| 0382 | H012 | CNE58_SU-strandC_bg505-NCgp120 + gp41.SOSIP | CNE58_SU-strandC/BG505 chimera | SOSIP; 664; R6 | BG505 Platform, Res. 166-173 (strand C) from CAP256-SU, remainder = CNE58 | |
| 0383 | H013 | 25925-2.22_bg505-NCgp120 + gp41.SOSIP | 25925-2.22/BG505 chimera | SOSIP; 664; R6 | BG505 Platform, remainder = 25925-2.22 | |
| 0384 | H014 | 3301_V1_C24_bg505-NCgp120 + gp41.SOSIP | 3301_V1_C24/BG505 chimera | SOSIP; 664; R6 | BG505 Platform, remainder = 3301_V1_C24 | |
| 0385 | H015 | ZM53-R166W_bg505-NCgp120 + gp41.SOSIP | ZM53-R166W/BG505 chimera | SOSIP; 664; R6 | BG505 Platform, remainder = ZM53-R166W | |
| 0386 | H016 | ZM53_bg505-NCgp120 + gp41.SOSIP | ZM53/BG505 chimera | SOSIP; 664; R6 | BG505 Platform, remainder = ZM53 gp120 | |

-continued

| 1<br>SEQ<br>ID NO | 2<br>Code | 3<br>Name | 4<br>Native<br>Background | 5<br>Mutations Compared to<br>Native Background | 6<br>Additional mutations | 7<br>Comment |
|---|---|---|---|---|---|---|
| 0387 | B170 | BG505.SOSIP.664.T332N_SC_1 | BG505 | SOSIP, 664, T332N | Circular permutant | Link gp120 Cterm to gp41 resi 664, and circ. permutate thru rest of gp41, end at 518 |
| 0388 | B171 | BG505.SOSIP.664.T332N_SC_2 | BG505 | SOSIP, 664, T332N | Circular permutant | same as PA_SC_1 above, vary linker |
| 0389 | B172 | BG505.SOSIP.664.T332N_SC_3 | BG505 | SOSIP, 664, T332N | Circular permutant | same as PA_SC_1 and PA_SC_2 above, vary linker |
| 0390 | B173 | BG505.SOSIP.664.T332N_SC_4 | BG505 | SOSIP, 664, T332N | Circular permutant | connects gp120 C term to region around 606-609, and extends forward, turncating at different regions) |
| 0391 | B174 | BG505.SOSIP.664.T332N_SC_5 | BG505 | SOSIP, 664, T332N | Circular permutant | only the inner circle of helices to hold the trimer together |
| 0392 | B175 | BG505.SOSIP.664.T332N_SC_6 | BG505 | SOSIP, 664, T332N | Circular permutant | Same as Seq_0391 |
| 0393 | B176 | BG505.SOSIP.664.T332N_SC_7 | BG505 | SOSIP, 664, T332N | Circular permutant | Same as Seq_0391 |
| 0394 | B177 | BG505.SOSIP.664.T332N_SC_8 | BG505 | SOSIP, 664, T332N | Circular permutant | Same as Seq_0391 |
| 0395 | B178 | BG505.SOSIP.664.T332N_SC_9 | BG505 | SOSIP, 664, T332N | Circular permutant | Start from resi 518, go to 664, connect to C-term of gp120, circ. permutate thru gp120 |
| 0396 | B179 | BG505.SOSIP.664.T332N_SC_10 | BG505 | SOSIP, 664, T332N | Circular permutant | same as PA_SC_9, change linker |
| 0397 | B180 | BG505.SOSIP.664.T332N_SC_11 | BG505 | SOSIP, 664, T332N | Circular permutant | same as PA_SC_9, change linker |
| 0398 | B181 | BG505.IP.664.T332N_1.2 | BG505 | SOSIP, 664, T332N | Circular permutant | Circular permutant single chain |
| 0399 | B182 | BG505.IP.664.T332N_1.3 | BG505 | SOSIP, 664, T332N | Circular permutant | Circular permutant single chain |
| 0400 | B183 | BG505.IP.664.T332N_2.1 | BG505 | SOSIP, 664, T332N | Circular permutant | Circular permutant single chain |
| 0401 | B184 | BG505.IP.664.T332N_2.2 | BG505 | SOSIP, 664, T332N | Circular permutant | Circular permutant single chain |
| 0402 | B185 | BG505.IP.664.T332N_2.3 | BG505 | SOSIP, 664, T332N | Circular permutant | Circular permutant single chain |
| 0403 | B186 | BG505.IP.664.T332N_3.1 | BG505 | SOSIP, 664, T332N | Circular permutant | Circular permutant single chain |
| 0404 | B187 | BG505.IP.664.T332N_3.3 | BG505 | SOSIP, 664, T332N | Circular permutant | Circular permutant single chain |

-continued

| SEQ ID NO | Code | Name | Native Background | Mutations Compared to Native Background | Additional mutations | Comment |
|---|---|---|---|---|---|---|
| 0405 | B188 | BG505.IP.664.T332N.sc1 | BG505 | IP, 664, T332N | 44-500-gsg-34-43-gsgg-526-664 | Circular permutant single chain |
| 0406 | B189 | BG505.SOSIP.664.T332N.sc2 | BG505 | SOSIP, 664, T332N | 44-502-gsggg-34-43-gsgg-526-664 | Circular permutant single chain |
| 0407 | B190 | BG505.IP.664.T332N.sc3 | BG505 | IP, 664, T332N | 44-500-gsg-34-42-gsgg-525-664 | Circular permutant single chain |
| 0408 | B191 | BG505.SOSIP.664.T332N.sc4 | BG505 | SOSIP, 664, T332N | 44-502-ggsgg-34-42-gsgg-525-664 | Circular permutant single chain |
| 0409 | C001 | BG505.SOSIP.R6.664.T332N_T90 | BG505 | SOSIP, R6, 664, T332N | T90C | gp140-35022complex-disulfide to 35022_S80 |
| 0410 | C002 | BG505.SOSIP.R6.664.T332N_P238 | BG505 | SOSIP, R6, 664, T332N | P238C | gp140-35022complex-disulfide to 35022_P77 |
| 0411 | C003 | BG505.SOSIP.R6.664.T332N_T529 | BG505 | SOSIP, R6, 664, T332N | T529C | gp140-35022complex-disulfide to 35022_D111 |
| 0412 | C004 | BG505.SOSIP.R6.664.T332N_D624 | BG505 | SOSIP, R6, 664, T332N | D624C | gp140-35022complex-disulfide to 35022_L109 or G112 |
| 0413 | C005 | BG505.SOSIP.R6.664.T332N_N625 | BG505 | SOSIP, R6, 664, T332N | N625C | gp140-35022complex-disulfide to 35022_L109 |
| 0414 | C006 | 35022_P77C | Ab 35022 | | P77C | gp140-35022complex-BG505.SOSIP.R6.664.T332N_P238 |
| 0415 | C007 | 35022_S80C | Ab 35022 | | S80C | gp140-35022complex-BG505.SOSIP.R6.664.T332N_T90 |
| 0416 | C008 | 35022_L109C | Ab 35022 | | L109C | gp140-35022complex-BG505.SOSIP.R6.664.T332N_D624 or BG505.SOSIP.R6.664.T332N_N625 |
| 0417 | C009 | 35022_D111C | Ab 35022 | | D111C | gp140-35022complex-BG505.SOSIP.R6.664.T332N_T529 |
| 0418 | C010 | 35022_G112C | Ab 35022 | | G112C | gp140-35022complex-BG505.SOSIP.R6.664.T332N_D624 |
| 0419 | C011 | BG505.SOSIP.R6.664.T332N_D624C | BG505 | SOSIP, R6, 664, T332N | D624C | gp140-35022complex |
| 0420 | C012 | BG505.SOSIP.R6.664.T332N_G459C | BG505 | SOSIP, R6, 664, T332N | G459C | gp140-VRC01complex |
| 0421 | C013 | JRFL IP 3C Strep G459C | JRFL | IP | 3C Strep G459C | gp140-VRC01complex |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0422 | C014 | BS208.61 SOSIP, R6, 664, G459C | BS208.61 | SOSIP, R6, 664 | G459C | gp140-VRC01complex |
| 0423 | C015 | KER2018.11 SOSIP, R6, 664, G459C | KER2018.11 | SOSIP, R6, 664 | G459C | gp140-VRC01complex |
| 0424 | C016 | C4118.09 SOSIP, R6, 664, G459C | C4118.09 | SOSIP, R6, 664 | G459C | gp140-VRC01complex |
| 0425 | C017 | TH966.8 SOSIP, R6, 664, G459C | TH966.8 | SOSIP, R6, 664 | G459C | gp140-VRC01complex |
| 0426 | C018 | WITO.33 SOSIP, R6, 664, G459C | WITO.33 | SOSIP, R6, 664 | G459C | gp140-VRC01complex |
| 0427 | C019 | CH181.12 SOSIP, R6, 664, G459C | CH181.12 | SOSIP, R6, 664 | G459C | gp140-VRC01complex |
| 0428 | C020 | BB201.B42 SOSIP, R6, 664, G459C | BB201.B42 | SOSIP, R6, 664 | G459C | gp140-VRC01complex |
| 0429 | C021 | Q842.d12 SOSIP, R6, 664, G459C | Q842.d12 | SOSIP, R6, 664 | G459C | gp140-VRC01complex |
| 0430 | C022 | AC10.29 SOSIP, R6, 664, G459C | AC10.29 | SOSIP, R6, 664 | G459C | gp140-VRC01complex |
| 0431 | C023 | BX08_16 SOSIP, R6, 664, G459C | BX08_16 | SOSIP, R6, 664 | G459C | gp140-VRC01complex |
| 0432 | C024 | 257102.43 SOSIP, R6, 664, G459C | 257102.43 | SOSIP, R6, 664 | G459C | gp140-VRC01complex |
| 0433 | C025 | 259252.22 SOSIP, R6, 664, G459C | 259252.22 | SOSIP, R6, 664 | G459C | gp140-VRC01complex |
| 0434 | C026 | S018_18 SOSIP, R6, 664, G459C | S018_18 | SOSIP, R6, 664 | G459C | gp140-VRC01complex |
| 0435 | C027 | X1193.c1 SOSIP, R6, 664, G459C | X1193.c1 | SOSIP, R6, 664 | G459C | gp140-VRC01complex |
| 0436 | C028 | SU SOSIP, R6, 664, G459C | SU | SOSIP, R6, 664 | G459C | gp140-VRC01complex |
| 0437 | C029 | BG505.SOSIP G459C V1V2 Swap BB201.B42 | BG505 | SOSIP | G459C, V1V2 Swap BB201.B42 | gp140-VRC01complex |
| 0438 | C030 | BG505.SOSIP G459C V1V2 Swap KER2018.11 | BG505 | SOSIP | G459C, V1V2 Swap KER2018.11 | gp140-VRC01complex |
| 0439 | C031 | BG505.SOSIP G459C V1V2_Swap_CH070.1 | BG505 | SOSIP | G459C, V1V2 Swap CH070.1 | gp140-VRC01complex |
| 0440 | C032 | BG505.SOSIP G459C V1V2_Swap_ZM233.6 | BG505 | SOSIP | G459C, V1V2 Swap ZM233.6 | gp140-VRC01complex |
| 0441 | C033 | BG505.SOSIP G459C V1V2 Swap Q23.17 | BG505 | SOSIP | G459C, V1V2 Swap Q23.17 | gp140-VRC01complex |
| 0442 | C034 | BG505.SOSIP G459C V1V2 Swap A244 | BG505 | SOSIP | G459C, V1V2 Swap A244 | gp140-VRC01complex |
| 0443 | C035 | BG505.SOSIP G459C V1V2 Swap WITO.33 | BG505 | SOSIP | G459C, V1V2 Swap WITO.33 | gp140-VRC01complex |
| 0444 | C036 | BG505_Cap256_G459C SU_V1V2_swap | BG505 | SOSIP | G459C, SU_V1V2_swap | gp140-VRC01complex |

-continued

| SEQ ID NO | Code | Name | Native Background | Mutations Compared to Native Background | Additional mutations | Comment |
|---|---|---|---|---|---|---|
| 0445 | C037 | VRC01 H A60C-His | VRC01 H Ab | | A60C | |
| 0446 | C038 | VRC01 H R61C-His | VRC01 H Ab | | A61C | |
| 0447 | C039 | VRC01 L | VRC01 L Ab | | | |
| 0448 | C040 | VRC01 H-His | VRC01 H Ab | | | |
| 0449 | C041 | VRC01LH scFv Tbn-His-Strep | VRC01 Ab | GGGGSGGGGSGGGGS | | |
| 0450 | C042 | VRC01LH scFv Tbn-His | VRC01 Ab | GGGGSGGGGSGGGGS | | |
| 0451 | C043 | VRC01LH scFv C60 Tbn-His | VRC01 Ab | GGGGSGGGGSGGGGS | | |
| 0452 | C044 | simVRC01.2 (Thr) H | VRC01 H Ab | | | |
| 0453 | C045 | simVRC01.2 C60 (Thr) H | VRC01 H Ab | | A60C | |
| 0454 | C046 | simVRC01.2 C60 (Thr) HS | VRC01 H Ab | | | |
| 0455 | C047 | simVRC01.2 L | VRC01 L Ab | | | |
| 0456 | C048 | simVRC01.2 C60 (Thr) L | VRC01 L Ab | | A60C | |
| 0457 | C049 | BG505.SOSIP.R6.664.T332N_I323C | BG505 | SOSIP, R6, 664, T332N | I323C | covalently bonded gp140-PGT122complex |
| 0458 | C050 | BG505.SOSIP.R6.664.T332N_G324C | BG505 | SOSIP, R6, 664, T332N | G324C | covalently bonded gp140-PGT122complex |
| 0459 | C051 | G122LH F67C | PGT122 H Ab | | F67C | |
| 0460 | C052 | G122LH G29C | PGT122 H Ab | | G29C | |
| 0461 | D001 | BG505.SOSIP.R6.664.T332N_Glyc504 | BG505 | SOSIP, R6, 664, T332N | 504N/506T | Glycan at R504 |
| 0462 | D002 | BG505.SOSIP.R6.664.T332N_Glyc661 | BG505 | SOSIP, R6, 664, T332N | 661N/663T | Glycan at L661 |
| 0463 | D003 | BG505.SOSIP.R6.664.T332N_Glyc504-661 | BG505 | SOSIP, R6, 664, T332N | 504N/506T, 661N/663T | Glycans at R504 and L661 |
| 0464 | D004 | BG505, SOSIP.R6.664.T332N_K502N_R504T | BG505 | SOSIP, R6, 664, T332N | K502N/R504T | Glycan at K502 |
| 0465 | D005 | BG505, SOSIP.R6.664.T332N_Q658N_L660T | BG505 | SOSIP, R6, 664, T332N | Q658N/L660T | Glycan at Q658 |
| 0466 | D006 | BG505, SOSIP.R6.664.T332N_W35T | BG505 | SOSIP, R6, 664, T332N | W35T | Glycan at N33 |
| 0467 | D007 | BG505, SOSIP.R6.664.T332N_W35N | BG505 | SOSIP, R6, 664, T332N | W35N | Glycan at W35 |

-continued

| SEQ ID NO | Code | Name | Native Background | Mutations Compared to Native Background | Additional mutations | Comment |
|---|---|---|---|---|---|---|
| 0468 | D008 | BG505.SOSIP.R6.664.T332N_W35N_R504N_V506T | BG505 | SOSIP, R6, 664, T332N | W35N, R504N/V506T | Glycan at W35 and R504 |
| 0469 | D009 | BG505.SOSIP.R6.664.T332N_W35T_gly661 | BG505 | SOSIP, R6, 664, T332N | W35T, gly661 | Glycan at N33 and L661 |
| 0470 | D010 | BG505.SOSIP.R6.664.T332N_W35T_K502N_R504T_gly661 | BG505 | SOSIP, R6, 664, T332N | W35T, K502N/R504T, gly661 | Glycan at K502 and L661 |
| 0471 | F001 | BG505.SOSIP.R6.664.T332N_ferritin | BG505 | SOSIP, R6, 664, T332N | onto ferritin | HIV-1 En trimer on nanoparticles |
| 0472 | F002 | BG505.SOSIP.R6.664.T332N_L5 | BG505 | SOSIP, R6, 664, T332N | onto Luminase synthase | HIV-1 En trimer on nanoparticles |
| 0473 | F003 | BG505.SOSIP.R6.664.T332N_3bve_ferr-24_1ln | BG505 | SOSIP, R6, 664, T332N | Helicobacter pylori ferritin | SOSIP - linker - particle |
| 0474 | F004 | BG505.SOSIP.R6.664.T332N_3bve_ferr-24_3ln | BG505 | SOSIP, R6, 664, T332N | Helicobacter pylori ferritin | SOSIP - linker - particle |
| 0475 | F005 | BG505.SOSIP.R6.664.T332N_3bve_ferr-24_15ln | BG505 | SOSIP, R6, 664, T332N | Helicobacter pylori ferritin | SOSIP - linker - particle |
| 0476 | F006 | BG505.SOSIP.R6.664.T332N_1hqk_ls-60_3ln | BG505 | SOSIP, R6, 664, T332N | lumazine synthase from aquifex aeolicus | SOSIP - linker - particle |
| 0477 | F007 | BG505.SOSIP.R6.664.T332N_1hqk_ls-60_15ln | BG505 | SOSIP, R6, 664, T332N | lumazine synthase from aquifex aeolicus | SOSIP - linker - particle |
| 0478 | F008 | BG505.SOSIP.R6.664.T332N_1ohg_bph-hk97-420_1ln | BG505 | SOSIP, R6, 664, T332N | DSDNA bacteriophage HK97 mature empty capsid | SOSIP - linker - particle |
| 0479 | F009 | BG505.SOSIP.R6.664.T332N_1ohg_bph-hk97-420_3ln | BG505 | SOSIP, R6, 664, T332N | DSDNA bacteriophage HK97 mature empty capsid | SOSIP - linker - particle |
| 0480 | F010 | BG505.SOSIP.R6.664.T332N_1ohg_bph-hk97-420_5ln | BG505 | SOSIP, R6, 664, T332N | DSDNA bacteriophage HK97 mature empty capsid | SOSIP - linker - particle |
| 0481 | F011 | BG505.SOSIP.R6.664.T332N_1ohg_bph-hk97-420_15ln | BG505 | SOSIP, R6, 664, T332N | DSDNA bacteriophage HK97 mature empty capsid | SOSIP - linker - particle |
| 0482 | F012 | BG505.SOSIP.R6.664.T332N_1qbe_bph-qB-180_7ln | BG505 | SOSIP, R6, 664, T332N | BACTERIOPHAGE Q BETA CAPSID | SOSIP - linker - particle |
| 0483 | F013 | BG505.SOSIP.R6.664.T332N_1qbe_bph-qB-180_15ln | BG505 | SOSIP, R6, 664, T332N | BACTERIOPHAGE Q BETA CAPSID | SOSIP - linker - particle |
| 0484 | F014 | BG505.SOSIP.R6.664.T332N_1dwn_bph-pp7-180_10ln | BG505 | SOSIP, R6, 664, T332N | bacteriophage PP7 from Pseudomonas aeruginosa | SOSIP - linker - particle |

| 1 SEQ ID NO | 2 Code | 3 Name | 4 Native Background | 5 Mutations Compared to Native Background | 6 Additional mutations | 7 Comment |
|---|---|---|---|---|---|---|
| 0485 | F015 | BG505.SOSIP.R6.664.T332N_1dwn_bph-pp7-180_15ln | BG505 | SOSIP, R6, 664, T332N | bacteriophage PP7 from Pseudomonas aeruginosa | SOSIP - linker - particle |
| 0486 | F016 | BG505.SOSIP.R6.664.T332N_2vf9_bph-prr1-180_10ln | BG505 | SOSIP, R6, 664, T332N | bacteriophage PRR1 | SOSIP - linker - particle |
| 0487 | F017 | BG505.SOSIP.R6.664.T332N_2vf9_bph-prr1-180_15ln | BG505 | SOSIP, R6, 664, T332N | bacteriophage PRR2 | SOSIP - linker - particle |
| 0488 | F018 | BG505.SOSIP.R6.664.T332N_1gav_bph-ga-180_10ln | BG505 | SOSIP, R6, 664, T332N | BACTERIOPHAGE GA PROTEIN CAPSID | SOSIP - linker - particle |
| 0489 | F019 | BG505.SOSIP.R6.664.T332N_1gav_bph-ga-180_15ln | BG505 | SOSIP, R6, 664, T332N | BACTERIOPHAGE GA PROTEIN CAPSID | SOSIP - linker - particle |
| 0490 | F020 | BG505.SOSIP.R6.664.T332N_2w4y_bph-5-180_10ln | BG505 | SOSIP, R6, 664, T332N | caulobacter bacteriophageSOSIP 5-virus-like particle | SOSIP - linker - particle |
| 0491 | F021 | BG505.SOSIP.R6.664.T332N_2w4y_bph-5-180_15ln | BG505 | SOSIP, R6, 664, T332N | caulobacter bacteriophageSOSIP 5-virus-like particle | SOSIP - linker - particle |
| 0492 | F022 | BG505.SOSIP.R6.664.T332N_1frs_bph-fr-180_10ln | BG505 | SOSIP, R6, 664, T332N | BACTERIOPHAGE FR CAPSID | SOSIP - linker - particle |
| 0493 | F023 | BG505.SOSIP.R6.664.T332N_1frs_bph-fr-180_15ln | BG505 | SOSIP, R6, 664, T332N | BACTERIOPHAGE FR CAPSID | SOSIP - linker - particle |
| 0494 | F024 | BG505.SOSIP.R6.664.T332N_1mva_ph-ms2-180_10ln | BG505 | SOSIP, R6, 664, T332N | PHAGE M52 PROTEIN CAPSID | SOSIP - linker - particle |
| 0495 | F025 | BG505.SOSIP.R6.664.T332N_1mva_ph-ms2-180_15ln | BG505 | SOSIP, R6, 664, T332N | PHAGE M52 PROTEIN CAPSID | SOSIP - linker - particle |
| 0496 | F026 | BG505.SOSIP.R6.664.T332N_2tbv_tom-v-180_7ln | BG505 | SOSIP, R6, 664, T332N | tomato bushy stunt virus.particle v. coat protein | SOSIP - linker - particle |
| 0497 | F027 | BG505.SOSIP.R6.664.T332N_2tbv_tom-v-180_15ln | BG505 | SOSIP, R6, 664, T332N | tomato bushy stunt virus.particle v. coat protein | SOSIP - linker - particle |
| 0498 | F028 | BG505.SOSIP.R6.664.T332N_1smv_sesb-mv-180_15ln | BG505 | SOSIP, R6, 664, T332N | SESBANIA MOSAIC VIRUS COAT PROTEIN | SOSIP - linker - particle |
| 0499 | F029 | BG505.SOSIP.R6.664.T332N_ismv_sesb-mv-180_15ln | BG505 | SOSIP, R6, 664, T332N | SESBANIA MOSAIC VIRUS COAT PROTEIN | SOSIP - linker - particle |
| 0500 | F030 | BG505.SOSIP.R6.664.T332N_1f2n_rice-ymv-180_7ln | BG505 | SOSIP, R6, 664, T332N | RICE YELLOW MOTTLE VIRUS particle | SOSIP - linker - particle |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0501 | F031 | BG505.SOSIP.R6.664.T332N_1f2n_rice-ymv-180_15ln | BG505 | SOSIP, R6, 664, T332N | RICE YELLOW MOTTLE VIRUS | particle - linker - SOSIP |
| 0502 | F032 | BG505.SOSIP.R6.664.T332N_1ng0_cfmv-180_7ln | BG505 | SOSIP, R6, 664, T332N | Cocksfoot mottle virus | particle - linker - SOSIP |
| 0503 | F033 | BG505.SOSIP.R6.664.T332N_1ng0_cfmv-180_15ln | BG505 | SOSIP, R6, 664, T332N | Cocksfoot mottle virus | particle - linker - SOSIP |
| 0504 | F034 | BG505.SOSIP.R6.664.T332N_2wqt_mhpd-60_1ln | BG505 | SOSIP, R6, 664, T332N | protein cage by *Escherichia coli* 2-hydroxypentadienoic acid hydratase | particle - linker - SOSIP |
| 0505 | F035 | BG505.SOSIP.R6.664.T332N_2wqt_mhpd-60_3ln | BG505 | SOSIP, R6, 664, T332N | Same as Seq_0504 | particle - linker - SOSIP |
| 0506 | F036 | BG505.SOSIP.R6.664.T332N_2wqt_mhpd-60_5ln | BG505 | SOSIP, R6, 664, T332N | Same as Seq_0504 | particle - linker - SOSIP |
| 0507 | F037 | BG505.SOSIP.R6.664.T332N_2wqt_mhpd-60_15ln | BG505 | SOSIP, R6, 664, T332N | Same as Seq_0504 | particle - linker - SOSIP |
| 0508 | G001 | BG505.SOSIP.R6.664.T332N_GGSGG_GCN4 | BG505 | SOSIP.R6.664.T332N | GGSGG_GCN4 | Trimerization domain |
| 0509 | G002 | BG505.SOSIP.R6.664.T332N_GGSGSGG_N_3HSH | BG505 | SOSIP.R6.664.T332N | GGSGSGG_N_3HSH | Trimerization domain atgp120 N-term |
| 0510 | G003 | BG505.SOSIP.R6.664.T332N_GG_C_3HSH | BG505 | SOSIP.R6.664.T332N | GG_C_3HSH | Trimerization domain at gp41 C-term |
| 0511 | H001 | BG505.SOSIP.R6.664.T332N, V1V2 Swap CAP256.SU | BG505 | SOSIP.R6.664.T332N | V1V2 Swap CAP256.SU | V1V2 Swap CAP256.SU |
| 0512 | H002 | BG505.SOSIP.R6.664.T332N, V1V2 Swap BB201.B42 | BG505 | SOSIP.R6.664.T332N | V1V2 Swap BB201.B42 | V1V2 Swap BB201.B42 |
| 0513 | H003 | BG505.SOSIP.R6.664.T332N, V1V2 Swap KER2018.11 | BG505 | SOSIP.R6.664.T332N | V1V2 Swap KER2018.11 | V1V2 Swap KER2018.11 |
| 0514 | H004 | BG505.SOSIP.R6.664.T332N, V1V2 Swap CH070.1 | BG505 | SOSIP.R6.664.T332N | V1V2 Swap CH070.1 | V1V2 Swap CH070.1 |
| 0515 | H005 | BG505.SOSIP.R6.664.T332N, V1V2 Swap ZM233.6 | BG505 | SOSIP.R6.664.T332N | V1V2 Swap ZM233.6 | V1V2 Swap ZM233.6 |
| 0516 | H006 | BG505.SOSIP.R6.664.T332N, V1V2 Swap Q23.17 | BG505 | SOSIP.R6.664.T332N | V1V2 Swap Q23.17 | V1V2 Swap Q23.17 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0517 | H007 | BG505.SOSIP.R6.664.T332N, V1V2 Swap A244 | BG505 | SOSIP.R6.664.T332N | V1V2 Swap A244 | V1V2 Swap A244 |
| 0518 | H008 | BG505.SOSIP.R6.664.T332N, V1V2 Swap WITO.33 | BG505 | SOSIP.R6.664.T332N | V1V2 Swap WITO.33 | V1V2 Swap WITO.33 |
| 0519 | Z001 | | | | | |
| 0520 | Z002 | | | | | |
| 0521 | Z003 | | | | | |
| 0522 | Z004 | | | | | |
| 0523 | Z005 | | | | | |
| 0524 | Z006 | | | | | |
| 0525 | Z007 | | | | | |
| 0526 | Z008 | | | | | |
| 0527 | Z009 | | | | | |
| 0528 | Z010 | | | | | |
| 0529 | Z011 | | | | | |
| 0530 | Z012 | | | | | |
| 0531 | Z013 | | | | | |
| 0532 | Z014 | | | | | |
| 0533 | Z015 | | | | | |
| 0534 | Z016 | | | | | |
| 0535 | Z017 | | | | | |
| 0536 | Z018 | | | | | |
| 0537 | Z019 | | | | | |
| 0538 | Z020 | | | | | |
| 0539 | Z021 | | | | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0540 | Z022 | | | | | |
| 0541 | Z023 | | | | | |
| 0542 | Z024 | | | | | |
| 0543 | T001 | BG505SOSIP.R6.664.T332N_C-6ln-HATM | BG505 | SOSIP.R6.664.T332N | | Transmembrane |
| 0544 | T002 | BG505SOSIP.R6.664.T332N_C-10ln-HATM | BG505 | SOSIP.R6.664.T332N | | Transmembrane |
| 0545 | T003 | bC-10ln_IP-6ln-HATM | BG505 | | | Transmembrane |
| 0546 | T004 | bC-10ln_IP-10ln-HATM | BG505 | | | Transmembrane |
| 0547 | T005 | BG505SOSIP.R6.664.T332N_N-NATM-6ln-C-6ln-HATM | BG505 | SOSIP.R6.664.T332N | | Transmembrane |
| 0548 | T006 | BG505SOSIP.R6.664.T332N_C-10ln-HATM | BG505 | SOSIP.R6.664.T332N | | Transmembrane |
| 0549 | T007 | bC-10ln_IP-N-NATM-6ln-6ln-HATM | BG505 | | | Transmembrane |
| 0550 | T008 | bC-10ln_IP-10ln-HATM | BG505 | | | Transmembrane |
| 0551 | T009 | BG505SOSIP.R6.664.T332N_A201C/A433C-N-NATM-6ln-C-6ln-HATM | BG505 | SOSIP.R6.664.T332N | A201C/A433C | Transmembrane |
| 0552 | T010 | BG505SOSIP.R6.664.T332N_A201C/A433C-C-10ln-HATM | BG505 | SOSIP.R6.664.T332N | A201C/A433C | Transmembrane |
| 0553 | T011 | bC-10ln_IP-A201C/A433C--N-NATM-6ln-C-6ln-HATM | BG505 | | | Transmembrane |
| 0554 | T012 | bC-10ln_IPA201C/A433C--10ln-HATM | BG505 | | | Transmembrane |
| 0555 | T013 | BG505SOSIP.R6.664.T332N_A201C/A433C-C-6ln-HATM | BG505 | SOSIP.R6.664.T332N | A201C/A433C | Transmembrane |
| 0556 | T014 | BG505SOSIP.R6.664.T332N_A201C/A433C-C-10ln-HATM | BG505 | SOSIP.R6.664.T332N | A201C/A433C | Transmembrane |
| 0557 | T015 | BG505SOSIP.R6.664.T332N_A201C/A433C-6ln-HATM | BG505 | SOSIP.R6.664.T332N | | Transmembrane |
| 0558 | T016 | bC-10ln_IP-A201C/A433C-10ln-HATM | BG505 | | | Transmembrane |
| 0559 | T017 | bC-10ln_IPA201C/A433C-N-NATM-6ln-C-6ln-HATM | BG505 | | | Transmembrane |
| 0560 | T018 | BG505SOSIP.R6.664.T332N_N-NATM-6ln | BG505 | SOSIP.R6.664.T332N | | Transmembrane |

-continued

| SEQ ID NO | Code | Name | Native Background | Mutations Compared to Native Background | Additional mutations | Comment |
|---|---|---|---|---|---|---|
| 0561 | T019 | BG505SOSIP.R6.664.T332N_N-101n-NATM | BG505 | SOSIP.R6.664.T332N | | Transmembrane |
| 0562 | T020 | bC-101n_IP-61n-N-NATM | BG505 | | | Transmembrane |
| 0563 | T021 | bC-101n_IP-101n-N-NATM | BG505 | | | Transmembrane |
| 0564 | T022 | BG505SOSIP.R6.664.T332N_A433P-N-NATM-61n-C-61n-HATM | BG505 | SOSIP.R6.664.T332N | A433P | Transmembrane |
| 0565 | T023 | BG505SOSIP.R6.664.T332N_A433P-C-101n-HATM | BG505 | SOSIP.R6.664.T332N | A433P | Transmembrane |
| 0566 | T024 | bC-101n_IPA433P--N-NATM-61n-61n-HATM | BG505 | | | Transmembrane |
| 0567 | T025 | bC-101n_IPA433P--101n-HATM | BG505 | | | Transmembrane |
| 0568 | T026 | BG505SOSIP.R6.664.T332N_A433P-C-61n-HATMBG505 | BG505 | SOSIP.R6.664.T332N | A433P | Transmembrane |
| 0569 | T027 | BG505SOSIP.R6.664.T332N_A433P-C-101n-HATM | BG505 | SOSIP.R6.664.T332N | A433P | Transmembrane |
| 0570 | T028 | bC-101n_IPA433P--61n-HATM | BG505 | | | Transmembrane |
| 0571 | T029 | bC-101n_IPA433P--101n-HATM | BG505 | | | Transmembrane |
| 0572 | Z025 | | | | | |
| 0573 | Z026 | | | | | |
| 0574 | Z027 | | | | | |
| 0575 | Z028 | | | | | ferritin subunit |
| 0576 | Z029 | | | | | lumazine synthase subunit |
| 0577 | Z030 | | | | | Sulfer Oxygenase Reductase subunit |
| 0578 | Z031 | | | | | Foldon domain |
| 0579 | H017 | Cap256-SU_bg505-NCgp120 + int + gp41.SOSIP | CAP256-SU/BG505 chimera | SOSIP, R6, 664 | | Chimeric gp140 with BG505 gp41ecto/gp120-NC + Interface Res. set A "platform" and heterologous gp120 BG505 Platform (Res. 31-45, 478-507, 512-664), BG505 Interface (Int.) Res. set A (Res. 46-54; 70-75; 84-89; 99; 102; 106; 107; 114; 215; 220-224; 226; 244; 471-473; 476-477), remainder = Cap256-SU |

| 1 SEQ ID NO | 2 Code | 3 Name | 4 Native Background | 5 Mutations Compared to Native Background | 6 Additional mutations | 7 Comment |
|---|---|---|---|---|---|---|
| 0580 | H018 | SHIV-1157ipd3N4_bg505-NCgp120 + int + gp41.SOSIP | SHIV-1157ipd3N4/ BG505 chimera | SOSIP, R6, 664 | BG505 Platform, Int. Res. set A; remainder- SHIV-1157ipd3N4 | Same as Seq_0579 |
| 0581 | H019 | CH117.4_332N_bg505-NCgp120 + int + gp41.SOSIP | CH117.4/BG505 chimera | SOSIP, R6, 664 | BG505 Platform, Int. Res. set A; remainder- CH117.4 gp120 | Same as Seq_0579 |
| 0582 | H020 | CNE58_SU-strandC_bg505-NCgp120 + int + gp41.SOSIP | CNE58_SU-strandC/BG505 chimera | SOSIP, R6, 664 | BG505 Platform, Int. Res. set A; remainder- CNE58_SU-strandC | Same as Seq_0579 |
| 0583 | H021 | 25925-2.22_bg505-NCgp120 + int + gp41.SOSIP | 25925-2.22/ BG505 chimera | SOSIP, R6, 664 | BG505 Platform, Int. Res. set A; remainder- 25925-2.22 | Same as Seq_0579 |
| 0584 | H022 | 3301_V1_C24_bg505-NCgp120 + int + gp41.SOSIP | 3301_V1_C24/ BG505 chimera | SOSIP, R6, 664 | BG505 Platform, Int. Res. set A; remainder- 3301_V1_C24 | Same as Seq_0579 |
| 0585 | H023 | ZM53-R166W_bg505-NCgp120 + int + gp41.SOSIP | ZM53/BG505 chimera | SOSIP, R6, 664 | BG505 Platform, Int. Res. set A; remainder- ZM53-R166Wgp120 | Same as Seq_0579 |
| 0586 | H024 | ZM53_bg505-NCgp120 + int + gp41.SOSIP | ZM53/BG505 chimera | SOSIP, R6, 664 | BG505 Platform, Int. Res. set A;; remainder- ZM53 | Same as Seq_0579 |
| 0587 | H025 | KER2018.11_bg505-NCgp120 + gp41.SOSIP | KER2018.11/BG505 chimera | SOSIP, R6, 664 | BG505 Platform, remainder = KER2018.11 | heterologous gp120 with (gp41 + gp120-NC (Res. 31-45; 478-507) from BG505.SOSIP) |
| 0588 | H026 | KER2018.11_bg505-NCgp120 + int + gp41.SOSIP | KER2018.11/BG505 chimera | SOSIP, R6, 664 | BG505 Platform, Int. Res. set A;; remainder- KER2018.11 | Same as Seq_0579 |
| 0589 | H027 | ZM233.6_bg505-NCgp120 + gp41.SOSIP | ZM233.6/BG505 chimera | SOSIP, R6, 664 | BG505 Platform, remainder = ZM233.6 | Same as Seq_0379 |
| 0590 | H028 | ZM233.6_bg505-NCgp120 + int + gp41.SOSIP | ZM233.6/BG505 chimera | SOSIP, R6, 664 | BG505 Platform, Int. Res. set A;; remainder- ZM233.6 | Same as Seq_0579 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0591 | H029 | UG037.8_bg505-NCgp120 + gp41.SOSIP | UG037.8/BG505 chimera | SOSIP, R6, 664 | BG505 Platform, BG505 Int. Res. set A;; remainder- UG037.8 | Same as Seq_0379 |
| 0592 | H030 | C13_psv02_bg505-NCgp120 + gp41.SOSIP | C13/BG505 chimera | SOSIP, R6, 664 | BG505 Platform, BG505 Int. Res. set A;; remainder- C13 | Same as Seq_0379 |
| 0593 | H031 | 45_01dG5_bg505-NCgp120 + gp41.SOSIP | 45_01dG5/BG505 chimera | SOSIP, R6, 664 | BG505 Platform, BG505 Int. Res. set A;; remainder- 45_01dG5 | Same as Seq_0379 |
| 0594 | H032 | ZM215.8-dCD4bsGlyc_bg505-NCgp120 + gp41.SOSIP | ZM215.8/BG505 chimera | SOSIP, R6, 664 | BG505 Platform, BG505 Int. Res. set A;; remainder- ZM215.8-dCD4bsGlyc | Same as Seq_0379 |
| 0595 | H033 | 426c-dCD4bsGlyc_bg505-NCgp120 + gp41.SOSIP | 426c/BG505 chimera | SOSIP, R6, 664 | BG505 Platform, BG505 Int. Res. set A;; remainder- 426c-dCD4bsGlyc | Same as Seq_0379 |
| 0596 | F038 | bg505.sosip_1dwn_bph-pp7-180_3-127_51n_mut1 | BG505 | SOSIP, R6, 664, T332N | bacteriophage PP7 | sosip - linker - particle |
| 0597 | F039 | bg505.sosip_1dwn_bph-pp7-180_3-127_81n_mut1 | BG505 | SOSIP, R6, 664, T332N | bacteriophage PP7 | Same as Seq_0596 |
| 0598 | F040 | bg505.sosip_1dwn_bph-pp7-180_3-127_81n_mut1 | BG505 | SOSIP, R6, 664, T332N | bacteriophage PP7 | Same as Seq_0596 |
| 0599 | F041 | bg505.sosip_1qbe_bph-qB-180_6-132_31n_mut1 | BG505 | SOSIP, R6, 664, T332N | BACTERIOPHAGE Q BETA CAPSID | Same as Seq_0596 |
| 0600 | F042 | bg505.sosip_1qbe_bph-qB-180_6-132_51n_mut1 | BG505 | SOSIP, R6, 664, T332N | BACTERIOPHAGE Q BETA CAPSID | Same as Seq_0596 |
| 0601 | F043 | bg505.sosip_1qbe_bph-qB-180_6-132_10ln_mut1 | BG505 | SOSIP, R6, 664, T332N | BACTERIOPHAGE Q BETA CAPSID | Same as Seq_0596 |
| 0602 | F044 | bg505.sosip_2vf9_bph-prr1-180_6-131_31n_mut1 | BG505 | SOSIP, R6, 664, T332N | bacteriophage PRR1 | Same as Seq_0596 |
| 0603 | F045 | bg505.sosip_2vf9_bph-prr1-180_6-131_51n_mut1 | BG505 | SOSIP, R6, 664, T332N | bacteriophage PRR1 | Same as Seq_0596 |
| 0604 | F046 | bg505.sosip_2vf9_bph-prr1-180_6-131_10ln_mut1 | BG505 | SOSIP, R6, 664, T332N | bacteriophage PRR1 | Same as Seq_0596 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0605 | F047 | bg505.sosip_1gav_bph-ga-180_7-129_3ln_mut1 | BG505 | SOSIP, R6, 664, T332N | BACTERIOPHAGE GA PROTEIN CAPSID | Same as Seq_0596 |
| 0606 | F048 | bg505.sosip_1gav_bph-ga-180_7-129_5ln_mut1 | BG505 | SOSIP, R6, 664, T332N | BACTERIOPHAGE GA PROTEIN CAPSID | Same as Seq_0596 |
| 0607 | F049 | bg505.sosip_1gav_bph-ga-180_7-129_10ln_mut1 | BG505 | SOSIP, R6, 664, T332N | BACTERIOPHAGE GA PROTEIN CAPSID | Same as Seq_0596 |
| 0608 | F050 | bg505.sosip_1frs_bph-fr-180_7-129_5ln_mut1 | BG505 | SOSIP, R6, 664, T332N | BACTERIOPHAGE FR CAPSID | Same as Seq_0596 |
| 0609 | F051 | bg505.sosip_1frs_bph-fr-180_7-129_10ln_mut1 | BG505 | SOSIP, R6, 664, T332N | BACTERIOPHAGE FR CAPSID | Same as Seq_0596 |
| 0610 | F052 | bg505.sosip_1frs_bph-fr-180_7-129_15ln_mut1 | BG505 | SOSIP, R6, 664, T332N | BACTERIOPHAGE FR CAPSID | Same as Seq_0596 |
| 0611 | F053 | bg505.sosip_1mva_ph-ms2-180_7-129_5ln_mut1 | BG505 | SOSIP, R6, 664, T332N | PHAGE M52 PROTEIN CAPSID | Same as Seq_0596 |
| 0612 | F054 | bg505.sosip_1mva_ph-ms2-180_7-129_10ln_mut1 | BG505 | SOSIP, R6, 664, T332N | PHAGE M52 PROTEIN CAPSID | Same as Seq_0596 |
| 0613 | F055 | bg505.sosip_1mva_ph-ms2-180_7-129_15ln_mut1 | BG505 | SOSIP, R6, 664, T332N | PHAGE M52 PROTEIN CAPSID | Same as Seq_0596 |
| 0614 | F056 | bg505.sosip_1hqk_ls-60_9ln_mut1 | BG505 | SOSIP, R6, 664, T332N | LUMAZINE SYNTHASE FROM AQUIFEX AEOLICUS | Same as Seq_0596 |
| 0615 | F057 | bg505.sosip_3bve_ferr-24_9ln_mut1 | BG505 | SOSIP, R6, 664, T332N | Helicobacter pylori ferritin | Same as Seq_0596 |
| 0616 | F058 | BG505.SOSIP.linker_1AA7_Ln9 | BG505 | SOSIP, R6, 664, T332N | M1 protein | sosip-self-assembling protein cage |
| 0617 | F059 | BG505.SOSIP.linker_1AA7_Ln12 | BG505 | SOSIP, R6, 664, T332N | M1 protein | sosip-self-assembling protein cage |
| 0618 | F060 | BG505.SOSIP.linker_1AA7_Ln15 | BG505 | SOSIP, R6, 664, T332N | M1 protein | sosip-self-assembling protein cage |
| 0619 | F061 | BG505.SOSIP.linker_1AA7_Ln18 | BG505 | SOSIP, R6, 664, T332N | M1 protein | sosip-self-assembling protein cage |
| 0620 | F062 | BG505SOSIP-linker3-3VDX | BG505 | SOSIP, R6, 664, T332N | 3VDX Cage | sosip-self-assembling protein cage |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0621 | F063 | BG505SOSIP-linker8-3VDX | BG505 | SOSIP, R6, 664, T332N | 3VDX Cage | sosip-self-assembling protein cage |
| 0622 | F064 | BG505SOSIP-linker9-3VDX | BG505 | SOSIP, R6, 664, T332N | 3VDX Cage | sosip-self-assembling protein cage |
| 0623 | F065 | BG505SOSIP-linker12-3VDX | BG505 | SOSIP, R6, 664, T332N | 3VDX Cage | sosip-self-assembling protein cage |
| 0624 | F066 | BG505SOSIP-linker15-3VDX | BG505 | SOSIP, R6, 664, T332N | 3VDX Cage | sosip-self-assembling protein cage |
| 0625 | F067 | BG505SOSIP-linker18-3VDX | BG505 | SOSIP, R6, 664, T332N | 3VDX Cage | sosip-self-assembling protein cage |
| 0626 | F068 | BG505.SOSIP.T332N_ZM233_NtermH1_4_Ferritin | BG505 | Circ. permut., SOSIP, T332N, 664, V1V2 swap, nanoparticle | | Circ. permut. V1V2 swap nanoparticle |
| 0627 | F069 | BG505.SOSIP.T332N_Ker2018_NtermH1_4_Ferritin | BG505 | Same as Seq_0626 | | Same as Seq_0626 |
| 0628 | F070 | BG505.SOSIP.T332N_ZM233_NtermH1_4_Ferritin | BG505 | Same as Seq_0626 | 201C, 433C | Same as Seq_0626 |
| 0629 | F071 | BG505.SOSIP.T332N_Ker2018_NtermH1_4_Ferritin | BG505 | Same as Seq_0626 | 201C, 433C | Same as Seq_0626 |
| 0630 | F072 | BG505.SOSIP.T332N_ZM233_NtermH1_6_Ferritin | BG505 | Same as Seq_0626 | | Same as Seq_0626 |
| 0631 | F073 | BG505.SOSIP.T332N_KER2018_NtermH1_6_Ferritin | BG505 | Same as Seq_0626 | | Same as Seq_0626 |
| 0632 | F074 | BG505.SOSIP.T332N_ZM233_NtermH1_6_longer_Ferritin | BG505 | Same as Seq_0626 | | Same as Seq_0626 |
| 0633 | F075 | BG505.SOSIP.T332N_KER2018_NtermH1_6_longer_Ferritin | BG505 | Same as Seq_0626 | | Same as Seq_0626 |
| 0634 | F076 | BG505.SOSIP.T332N_ZM233_NtermH1_12_Ferritin | BG505 | Same as Seq_0626 | | Same as Seq_0626 |
| 0635 | F077 | BG505.SOSIP.T332N_KER2018_NtermH1_12_Ferritin | BG505 | Same as Seq_0626 | | Same as Seq_0626 |
| 0636 | F078 | BG505.SOSIP.T332N_ZM233_NtermH1_Tri_Ferritin | BG505 | Same as Seq_0626 | | Same as Seq_0626 |

-continued

| SEQ ID NO | Code | Name | Native Background | Mutations Compared to Native Background | Additional mutations | Comment |
|---|---|---|---|---|---|---|
| 0637 | F079 | BG505.SOSIP.T332N_KER2018_NtermH1_Tri_Ferritin | BG505 | Same as Seq_0626 | | Same as Seq_0626 |
| 0638 | F080 | BG505.SOSIP.T332N_KER2018_Circ_LS | BG505 | Same as Seq_0626 | | Same as Seq_0626 |
| 0639 | F081 | BG505.SOSIP.T332N_KER2018_Circ_short_LS | BG505 | Same as Seq_0626 | | Same as Seq_0626 |
| 0640 | F082 | BG505.SOSIP.T332N_KER2018_Circ_long_LS | BG505 | Same as Seq_0626 | | Same as Seq_0626 |
| 0641 | F083 | BG505.SOSIP.T332N_ZM233_Circ_LS | BG505 | Same as Seq_0626 | | Same as Seq_0626 |
| 0642 | F084 | BG505.SOSIP.T332N_ZM233_201C433C_Circ_LSBG505 | BG505 | Same as Seq_0626 | 201C, 433C | Same as Seq_0626 |
| 0643 | F085 | BG505.SOSIP.T332N_ZM233_NtermH1_Tri_LS | BG505 | Same as Seq_0626 | | Same as Seq_0626 |
| 0644 | F086 | BG505.SOSIP.T332N_KER2018_NtermH1_Tri_LSBG505 | BG505 | Same as Seq_0626 | | Same as Seq_0626 |
| 0645 | F087 | BG505.SOSIP.T332N_ZM233_NtermH1_Tri_201C433C_LS | BG505 | Same as Seq_0626 | 201C, 433C | |
| 0646 | A204 | BG505.SOSIP.R6.664.T332N_I225C/V245C | BG505 | SOSIP, R6, 664, T332N | I225C/V245C | DS |
| 0647 | A205 | BG505.SOSIP.R6.664.T332N_V3bC_T606C | BG505 | SOSIP, R6, 664, T332N | V36C_T606C | DS |
| 0648 | A206 | BG505.SOSIP.R6.664.T332N_T37C_T606C | BG505 | SOSIP, R6, 664, T332N | T37C_T606C | DS |
| 0649 | A207 | BG505.SOSIP.R6.664.T332N_V36C_V496C | BG505 | SOSIP, R6, 664, T332N | V36C_V496C | DS |
| 0650 | A208 | BG505.SOSIP.R6.664.T332N_V36C_P498C | BG505 | SOSIP, R6, 664, T332N | V36C_P498C | DS |
| 0651 | A209 | BG505.SOSIP.R6.664.T332N_T37C_A497C | BG505 | SOSIP, R6, 664, T332N | T37C_A497C | DS |
| 0652 | A210 | BG505.SOSIP.R6.664.T332N_V38C/V496C | BG505 | SOSIP, R6, 664, T332N | V38C_V496C | DS |
| 0653 | A211 | BG505.SOSIP.R6.664.T332N_A200C/Q432C | BG505 | SOSIP, R6, 664, T332N | A200C/Q432C | DS |
| 0654 | A212 | BG505.SOSIP.R6.664.T332N_T202C/M434C | BG505 | SOSIP, R6, 664, T332N | T202C_M434C | DS |
| 0655 | A213 | BG505.SOSIP.R6.664.T332N_T202C/M434C/G431F | BG505 | SOSIP, R6, 664, T332N | T202C_M434C_G431F | DS, CavF at gp120 C4 substitued with F and stablize gp120, interprotomer |
| 0656 | A214 | BG505.SOSIP.R6.664.T332N_T202C_A433C | BG505 | SOSIP, R6, 664, T332N | T202C_A433C | DS |
| 0657 | A215 | BG505.SOSIP.R6.664.T332N_V182D | BG505 | SOSIP, R6, 664, T332N | V182D | salt bridge at gp120 V2 to stablize V2 by subtitution of D, |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0658 | A216 | BG505.SOSIP.R6.664.T332N_I251F/L260F | BG505 | SOSIP, R6, 664, T332N | I251F/L260F | hydrophobic core betwen gp120 V2/V3 with double F substitution to stabilize V1/V2/V3 |
| 0659 | A217 | BG505.SOSIP.R6.664.T332N_I225C/V488C | BG505 | SOSIP, R6, 664, T332N | I225C/V488C | DS |
| 0660 | A218 | BG505.SOSIP.R6.664.T332N_N478F | BG505 | SOSIP, R6, 664, T332N | N478F | CavF at gp120 C terminus substitued with F and stabilize gp120 C terminus |
| 0661 | A219 | BG505.SOSIP.R6.664.T332N_T163D_Q170R | BG505 | SOSIP, R6, 664, T332N | T163D_Q170R | salt bridge at gp120 V2 to stablize V1/V2 with -continued

| SEQ ID NO | Code | Name | Native Background | Mutations Compared to Native Background | Additional mutations | Comment |
|---|---|---|---|---|---|---|
| 0672 | A230 | BG505.SOSIP.R6.664.T332N_L261F | BG505 | SOSIP, R6, 664, T332N | L261F | CavF at gp120 C2 with F substitution to stabilize gp120, interprotomer |
| 0673 | A231 | BG505.SOSIP.R6.664.T332N_G263W | BG505 | SOSIP, R6, 664, T332N | G263W | CavF at gp120 C2 with W substitution to stabilize gp120, interprotomer |
| 0674 | A232 | BG505.SOSIP.R6.664.T332N_A55F_V75F | BG505 | SOSIP, R6, 664, T332N | A55F_V75F | hydrophobic core at gp120 C1 with double-F substitution to stabilize gp120 N terminus |
| 0675 | A233 | BG505.SOSIP.R6.664.T332N_T77F_V245F | BG505 | SOSIP, R6, 664, T332N | T77F_V245F | hydrophobic core at gp120 C1/C2 with double-F substitution to stabilize gp120 N terminus |
| 0676 | A234 | BG505.SOSIP.R6.664.T332N_T77F | BG505 | SOSIP, R6, 664, T332N | T77F | CavF at gp120 C1 with F substitution to stabilize gp120 N terminus |
| 0677 | A235 | BG505.SOSIP.R6.664.T332N_S56H_P76E | BG505 | SOSIP, R6, 664, T332N | S56H_P76E | salt bridge at gp120 N terminus with H and E substitution |
| 0678 | A236 | BG505.SOSIP.R6.664.T332N_A55F | BG505 | SOSIP, R6, 664, T332N | A55F | CavF at gp120 C1 with F substitution C to stabilize gp120 N terminus |
| 0679 | A237 | BG505.SOSIP.R6.664.T332N_A55F_P81W | BG505 | SOSIP, R6, 664, T332N | A55F_P81W | hydrophobic core at gp120 C1 with F and W substitution to stabilize gp120 N terminus |
| 0680 | A238 | BG505.SOSIP.R6.664.T332N_L52F_I215W | BG505 | SOSIP, R6, 664, T332N | L52F_I215W | hydrophobic core at gp120 C1/C2 with double-F substitution to stabilize gp120 N terminus |
| 0681 | A239 | BG505.SOSIP.R6.664.T332N_I109K_Q428E | BG505 | SOSIP, R6, 664, T332N | I109K_Q428E | salt bridge at gp120 C1/C4 to stabilize gp120 N/C terminus with K and E substitution |
| 0682 | A240 | BG505.SOSIP.R6.664.T332N_T257C_S375C | BG505 | SOSIP, R6, 664, T332N | T257C_S375C | DS -continued

| SEQ ID NO | Code | Name | Native Background | Mutations Compared to Native Background | Additional mutations | Comment |
|---|---|---|---|---|---|---|
| 0685 | A243 | BG505.SOSIP.R6.664.T332N_L125F | BG505 | SOSIP, R6, 664, T332N | L125F | CavF at gp120 V1/V2. Substitute F to stabilize V1/V2/V3 |
| 0686 | A244 | BG505.SOSIP.R6.664.T332N_N136W | BG505 | SOSIP, R6, 664, T332N | N136W | CavF at gp120 V1. Substitute W to stabilize V1/V2/V3 |
| 0687 | A245 | BG505.SOSIP.R6.664.T332N_N136W_L154W | BG505 | SOSIP, R6, 664, T332N | N136W_L154W | hydrophobic core at gp120 V1 with double W substitution to stabilize gp120 V1/V2 |
| 0688 | A246 | BG505.SOSIP.R6.664.T332N_L193F_N195C_I423C | BG505 | SOSIP, R6, 664, T332N | L193F_N195C_I423C | DS, CavF at gp120 V1 substituted with F and stabilize V1/V2, interprotomer |
| 0689 | A247 | BG505.SOSIP.R6.664.T332N_I323W_I326F | BG505 | SOSIP, R6, 664, T332N | I323W_I326F | hydrophobic core at gp120 V3 with W or F substitution to stabilize gp120 V1/V2/V3 |
| 0690 | A248 | BG505.SOSIP.R6.664.T332N_I323W | BG505 | SOSIP, R6, 664, T332N | I323W | CavF at gp120 V3. Substitute F to stabilize V1/V2/V3 |
| 0691 | A249 | BG505.SOSIP.R6.664.T332N_I326F | BG505 | SOSIP, R6, 664, T332N | I326F | CavF at gp120 V3. Substitute F to stabilize V1/V2/V3 |
| 0692 | A250 | BG505.SOSIP.R6.664.T332N_M475F_N478F | BG505 | SOSIP, R6, 664, T332N | M475F_N478F | hydrophobic core at gp120 V3 with W or F substitution to stabilize gp120 V1/V2/V3 |
| 0693 | A251 | BG505.SOSIP.R6.664.T332N_Q130H | BG505 | SOSIP, R6, 664, T332N | Q130H | salt bridge at gp120 C1 to stabilize gp120 N/C terminus with H substitution |
| 0694 | A252 | BG505.SOSIP.R6.664.T332N_Q103D_T106K | BG505 | SOSIP, R6, 664, T332N | Q103D_T106K | salt bridge at gp120 C1 to stabilize gp120 N/C terminus with K and D substitution |
| 0695 | A253 | BG505.SOSIP.R6.664.T332N_S110H_Q114E | BG505 | SOSIP, R6, 664, T332N | S110H_Q114E | salt bridge at gp120 C1 to stabilize gp120 N/C terminus with H and E substitution |
| 0696 | A254 | BG505.SOSIP.R6.664.T332N_M150F_I326W | BG505 | SOSIP, R6, 664, T332N | M150F_I326W | hydrophobic core at gp120 V3 with W or F substitution to stabilize gp120 V1/V3 |
| 0697 | A255 | BG505.SOSIP.R6.664.T332N_L111W | BG505 | SOSIP, R6, 664, T332N | L111W | CavF at gp120 C1. Substitute W to stabilize gp120 terminus |

-continued

| SEQ ID NO | Code | Name | Native Background | Mutations Compared to Native Background | Additional mutations | Comment |
|---|---|---|---|---|---|---|
| 0698 | A256 | BG505.SOSIP.R6.664.T332N_A204F_V208W | BG505 | SOSIP, R6, 664, T332N | A204F_V208W | hydrophobic core at gp120 C2 with W or F substitution to stabilize gp120 V1/V2/V3, interprotomer |
| 0699 | A257 | BG505.SOSIP.R6.664.T332N_L537C_G41C | BG505 | SOSIP, R6, 664, T332N | L537C_G41C | DS |
| 0700 | A258 | BG505.SOSIP.R6.664.T332N_V245F | BG505 | SOSIP, R6, 664, T332N | V245F | CavF at gp120 C2. Substitute F to stabilize gp120 V1/V2/V3, interprotomer |
| 0701 | A259 | BG505.SOSIP.R6.664.T332N_L125W.I195W | BG505 | SOSIP, R6, 664, T332N | L125W, I195W | Cavity filling of V1V2-V3 inter -continued

| SEQ ID NO | Code | Name | Native Background | Mutations Compared to Native Background | Additional mutations | Comment |
|---|---|---|---|---|---|---|
| 0713 | A271 | BG505.SOSIP.R6.664.T332N_T198F | BG505 | SOSIP, R6, 664, T332N | T198F | CavF: V1V2-gp120core interface |
| 0714 | A272 | BG505.SOSIP.R6.664.T332N_T202F | BG505 | SOSIP, R6, 664, T332N | T202F | CavF: V1V2-gp120core interface, Substitute F or W, |
| 0715 | A273 | BG505.SOSIP.R6.664.T332N_T202W | BG505 | SOSIP, R6, 664, T332N | T202W | CavF: V1V2-gp120core interface |
| 0716 | A274 | BG505.SOSIP.R6.664.T332N_A204F | BG505 | SOSIP, R6, 664, T332N | A204F | CavF: V1V2-gp120core interface, Substitute F or W, |
| 0717 | A275 | BG505.SOSIP.R6.664.T332N_I423F | BG505 | SOSIP, R6, 664, T332N | I423F | CavF: gp120core-V1V2 interface, Substitute F or W, |
| 0718 | A276 | BG505.SOSIP.R6.664.T332N_I423W | BG505 | SOSIP, R6, 664, T332N | I423W | CavF: gp120core-V1V2 interface |
| 0719 | A277 | BG505.SOSIP.R6.664.T332N_Q432F | BG505 | SOSIP, R6, 664, T332N | Q432F | CavF: stabilize unliganded conformation of bridging sheet region, Substitute F or W, |
| 0720 | A278 | BG505.SOSIP.R6.664.T332N_Q432W | BG505 | SOSIP, R6, 664, T332N | Q432W, | CavF: stabilize unliganded conformation of bridging sheet region |
| 0721 | A279 | BG505.SOSIP.R6.664.T332N_A436M | BG505 | SOSIP, R6, 664, T332N | A436M | CavF: stabilize unliganded conformation of bridging sheet region, Substitute F, M or W, |
| 0722 | A280 | BG505.SOSIP.R6.664.T332N_A436F | BG505 | SOSIP, R6, 664, T332N | A436F | Same as Seq_0721 |
| 0723 | A281 | BG505.SOSIP.R6.664.T332N_A436W | BG505 | SOSIP, R6, 664, T332N | A436W | Same as Seq_0721 |
| 0724 | A282 | BG505.SOSIP.R6.664.T332N_A204W | BG505 | SOSIP, R6, 664, T332N | A204W | CavF: V1V2-gp120core interface, Substitute F or W, |
| 0725 | A283 | BG505.SOSIP.R6.664.T332N_N302F | BG505 | SOSIP, R6, 664, T332N | N302F | CavF: V3-V1V2/gp120core interface, Substitute F or W, |
| 0726 | A284 | BG505.SOSIP.R6.664.T332N_N302W | BG505 | SOSIP, R6, 664, T332N | N302W | CavF: V3-V1V2/gp120core interface, Substitute F or W, |
| 0727 | A285 | BG505.SOSIP.R6.664.T332N_I307W | BG505 | SOSIP, R6, 664, T332N | I307W | V1V2/V3 stabilization/packing, Substitute F or W, |
| 0728 | A286 | BG505.SOSIP.R6.664.T332N_I307F | BG505 | SOSIP, R6, 664, T332N | I307F | V1V2/V3 stabilization/packing/ non-bridging sheet, Substitute F or W, |
| 0729 | A287 | BG505.SOSIP.R6.664.T332N_F210A | BG505 | SOSIP, R6, 664, T332N | F210A | α-1 helix/destablize CD4-bound conformation |

| SEQ ID NO | Code | Name | Native Background | Mutations Compared to Native Background | Additional mutations | Comment |
|---|---|---|---|---|---|---|
| 0730 | A288 | BG505.SOSIP.R6.664.T332N_F176W_I323Y | BG505 | SOSIP, R6, 664, T332N | F176W/I323Y | CavF at gp120 V1/V2. 176: Substitute Y or W; 323: F, Y, or W; stabilize V1/V2/V3 |
| 0731 | A289 | BG505.SOSIP.R6.664.T332N_F176W_L154W | BG505 | SOSIP, R6, 664, T332N | F176W/L154W | CavF at gp120 V1/V2. 176: Substitute Y or W; 154: F, Y, or W; stabilize V1/V2/V3 |
| 0732 | A290 | BG505.SOSIP.R6.664.T332N_F159Y_L154W | BG505 | SOSIP, R6, 664, T332N | F159Y/L154W | CavF at gp120 V1/V2. 159: Substitute Y or W; 154: F, Y, or W; stabilize V1/V2/V3 |
| 0733 | A291 | BG505.SOSIP.R6.664.T332N_F176W | BG505 | SOSIP, R6, 664, T332N | F176W | CavF at gp120 V1/V2. Substitute Y or W; stabilize V1/V2/V3 |
| 0734 | A292 | BG505.R6.664_G41C_L537C | BG505 | R6, 664 | G41C_L537C | DS between gp120 and gp41 |
| 0735 | A293 | BG505.R6.664_G41C_A541C | BG505 | R6, 664 | G41C_A541C | DS between gp120 and gp41 |
| 0736 | A294 | BG505.R6.664_P43C_A526C | BG505 | R6, 664 | P43C_A526C | DS between gp120 and gp41 |
| 0737 | A295 | BG505.R6.664_A73C_G572C | BG505 | R6, 664 | A73C_G572C | DS between gp120 and gp41 |
| 0738 | A296 | BG505.R6.664_I84C_G521C | BG505 | R6, 664 | I84C_G521C | DS between gp120 and gp41 |
| 0739 | A297 | BG505.R6.664_V89C_G527C | BG505 | R6, 664 | V89C_G527C | DS between gp120 and gp41 |
| 0740 | A298 | BG505.IP.R6.664.T332N_A73C_G572C | BG505 | IP, R6, 664, T332N | A73C_G572C | DS between gp120 and gp41 |
| 0741 | A299 | BG505.IP.R6.664.T332N_I84C_G521C | BG505 | IP, R6, 664, T332N | I84C_G521C | DS between gp120 and gp41 |
| 0742 | A300 | BG505.IP.R6.664.T332N_V89C_G527C | BG505 | IP, R6, 664, T332N | V89C_G527C | DS between gp120 and gp41 |
| 0743 | A301 | BG505.SOSIP.R6.664.T332N_R304C/Q440C | BG505 | IP, R6, 664, T332N | R304C/Q440C | DS |
| 0744 | F088 | BG505.SOSIP.R6.664.T332N_I201C/A433C_polymer hFc fusion | BG505 | SOSIP, R6, 664, T332N | I201C/A433C | Polymeric Fc-fusion protein |
| 0745 | 0 | ZM233.6 | ZM233.6 | | | |
| 0746 | 0 | Q23.17 | Q23.17 | | | |
| 0747 | 0 | A244 | A244 | | | |
| 0748 | 0 | WITO.33 | WITO.33 | | | |
| 0749 | 0 | ZM53.12 | ZM53.12 | | | |

| SEQ ID NO | Code | Name | Native Background | Mutations Compared to Native Background | Additional mutations | Comment |
|---|---|---|---|---|---|---|
| 0750 | 0 | CNE58 | CNE58 | | | |
| 0751 | 0 | 3301_V1_C24 | 3301_V1_C24 | | | |
| 0752 | Z032 | foldon domain | | | | |
| 0753 | Z033 | foldon domain | | | | |
| 0754 | Z034 | foldon domain | | | | |
| 0755 | Z035 | foldon domain | | | | |
| 0756 | Z036 | Encapsulin subunit | | | | |
| 0757 | Z037 | DNA encoding SEQ ID NO: 352 | | | | |
| 0758 | Z038 | BG505 transmembrane domain | | | | |
| 0759 | Z039 | DNA encoding BG505 transmembrane domain | | | | |
| 0760 | Z040 | Influenza A Hemagglutinin transmembrane domain | | | | |
| 0761 | Z041 | DNA encoding Influenza A Hemagglutinin transmembrane domain | | | | |
| 0762 | Z042 | Influenza A Neuraminidase transmembrane domain | | | | |
| 0763 | Z043 | DNA encoding Influenza A Neuraminidase transmembrane domain | | | | |
| 0764 | H034 | Cap256-SU_bg505-NCgp120 + gp41.SOSIP_ds201-433 | CAP256-SU/BG505 chimera | SOSIP, R6, 664 | CAP256-SU gp120 with (gp41 + gp120-NC from BG505.SOSIP) | heterologous gp120 with gp120-NC (Res. 31-45; 478-507) from BG505.SOSIP |
| 0765 | H035 | 3301_bg505-NCgp120 + gp41.SOSIP_ds201-433 | 3301_V1_C24/ BG505 chimera | SOSIP, R6, 664 | 3301_V1_C24 gp120 with (gp41 + gp120-NC from BG505.SOSIP) | Same as Seq_0764 |
| 0766 | H036 | ZM53_bg505-NCgp120 + gp41.SOSIP_ds201-433 | ZM53/BG505 chimera | SOSIP, R6, 664 | ZM53 gp120 with (gp41 + gp120-NC from BG505.SOSIP) | Same as seq_0764 |
| 0767 | H037 | Cap256-SU_bg505-NCgp120 + gp41.SOSIP + int_ds201-433 | CAP256-SU/BG505 chimera | SOSIP, R6, 664 | CAP256-SU gp120 with (gp41 + gp120-NC from BG505.SOSIP) | BG505 Platform + Int. Res. Set A |

| SEQ ID NO | Code | Name | Native Background | Mutations Compared to Native Background | Additional mutations | Comment |
|---|---|---|---|---|---|---|
| 0768 | H038 | 3301_bg505-NCgp120 + gp41.SOSIP + int_ds201-433 | 3301_V1_C24/BG505 chimera | SOSIP, R6, 664 | 3301_V1_C24 gp120 with (gp41 + gp120-NC from BG505.SOSIP) | Same as Seq_0767 |
| 0769 | H039 | ZM53_bg505-NCgp120 + gp41.SOSIP + int_ds201-433 | ZM53/BG505 chimera | SOSIP, R6, 664 | ZM53 gp120 with (gp41 + gp120-NC from BG505.SOSIP) | Same as Seq_0767 |
| 0770 | H040 | CNE58-SUstrandC_bg505-NCgp120 + gp41.SOSIP_ds201-433 | CNE58/BG505 chimera | SOSIP, R6, 664 | CNE58 gp120 with (gp41 + gp120-NC from BG505.SOSIP) and (strand C from CAP256-SU) | BG505 Platform and Res. 166-173 from CAP256-SU |
| 0771 | H041 | CNE58-SUstrandC_bg505-NCgp120 + gp41.SOSIP_ds304-440 | CNE58/BG505 chimera | SOSIP, R6, 664 | CNE58 gp120 with (gp41 + gp120-NC from BG505.SOSIP) and (strand C from CAP256-SU) | BG505 Platform and Res. 166-173 from CAP256-SU |
| 0772 | H042 | BG505.SOSIP.664.R6.T332N | BG505/CAP45 chimera | SOSIP, R6, 664, T332N | CAP45 as gp41 sequence | BG505.SOSIP.664.R6.T332N construct with gp41 from CAP45 |
| 0773 | A302 | JR-FLgp140.6R.SOSIP.664.E168K_I201C/A433C | JR-FL | SOSIP, R6, 664, E168K | I201C/A433C | |
| 0774 | A303 | JR-FLgp140.6R.SOSIP.664.E168K_A433P | JR-FL | SOSIP, R6, 664, E168K | A433P | |
| 0775 | A304 | JR-FLgp140.6R.SOSIP.664.E168K_Q432P | JR-FL | SOSIP, R6, 664, E168K | Q432P | |
| 0776 | A305 | JR-FLgp140.6R.SOSIP.664.E168K_S174C/A319C | JR-FL | SOSIP, R6, 664, E168K | S174C/A319C | |
| 0777 | A306 | JR-FLgp140.6R.SOSIP.664.E168K_N195C/A433C | JR-FL | SOSIP, R6, 664, E168K | N195C/A433C | |
| 0778 | A307 | JR-FLgp140.6R.SOSIP.664.E168K_S199C/A433C | JR-FL | SOSIP, R6, 664, E168K | S199C/A433C | |
| 0779 | A308 | JR-FLgp140.6R.SOSIP.664.E168K_R304C/Q440C | JR-FL | SOSIP, R6, 664, E168K | R304C/Q440C | |
| 0780 | A309 | JR-FLgp140.6R.SOSIP.664.E168K_F223W | JR-FL | SOSIP, R6, 664, E168K | F223W | |
| 0781 | A310 | JR-FLgp140.6R.SOSIP.664.E168K_G473Y | JR-FL | SOSIP, R6, 664, E168K | G473Y | |
| 0782 | A311 | JR-FLgp140.6R.SOSIP.664.E168K_G431P | JR-FL | SOSIP, R6, 664, E168K | G431P | |
| 0783 | A312 | JR-FLgp140.6R.SOSIP.664.E168K_N425C_A433C | JR-FL | SOSIP, R6, 664, E168K | N425C_A433C | |

| SEQ ID NO | Code | Name | Native Background | Mutations Compared to Native Background | Additional mutations | Comment |
|---|---|---|---|---|---|---|
| 0784 | A313 | JR-FLgp140.6R.SOSIP.664.E168K_V120C_Q315C | JR-FL | SOSIP, R6, 664, E168K | V120C_Q315C | |
| 0785 | A314 | JR-FLgp140.6R.SOSIP.664.E168K_Q203C_L122C | JR-FL | SOSIP, R6, 664, E168K | Q203C_L122C | |
| 0786 | A315 | JR-FLgp140.6R.SOSIP.664.E168K_I201C/A433C/R304C/Q440C | JR-FL | SOSIP, R6, 664, E168K | I201C/A433C/R304C/Q440C | |
| 0787 | A316 | JR-FLgp140.6R.SOSIP.664.E168K_R304C/R440C | JR-FL | SOSIP, R6, 664, E168K | R304C/R440C | Lock V3 to gp120 to prevent exposure/opening |
| 0788 | A317 | JR-FLgp140.6R.SOSIP.664.E168K_Q203C/F317C | JR -continued

| 1 SEQ ID NO | 2 Code | 3 Name | 4 Native Background | 5 Mutations Compared to Native Background | 6 Additional mutations | 7 Comment |
|---|---|---|---|---|---|---|
| 0801 | F093 | Q23.17_V1V2V3CAP_fer_10ln_gyc | Q23.17 | | Same as Seq_0797 | Same as Seq_0797 |
| 0802 | F094 | Q23.17_V1V2V3CAP_fer_5ln_gyc | Q23.17 | | Same as Seq_0797 | Same as Seq_0797 |
| 0803 | F095 | KER2008.12_V1V2V3CAP_LS_15ln_gyc | KER2008 | | V1V2V3 nanoparticle circ. permut., inter-subunit disulfide, lumazine synthase | Same as Seq_0797 |
| 0804 | F096 | KER2008.12_V1V2V3CAP_LS_10ln_gyc | KER2008 | | Same as Seq_0803 | Same as Seq_0797 |
| 0805 | F097 | KER2008.12_V1V2V3CAP_LS_10ln_gyc | KER2008 | | Same as Seq_0803 | Same as Seq_0797 |
| 0806 | F098 | Q23.17_V1V2V3CAP_LS_15ln_gyc | Q23.17 | | Same as Seq_0803 | Same as Seq_0797 |
| 0807 | F099 | Q23.17_V1V2V3CAP_LS_10ln_gyc | Q23.17 | | Same as Seq_0803 | Same as Seq_0797 |
| 0808 | F100 | Q23.17_V1V2V3CAP_LS_5ln_gyc | Q23.17 | | Same as Seq_0803 | Same as Seq_0797 |
| 0809 | F101 | KER2008.12_ds175_320_V1V2V3CAP_fer_15ln_gyc | KER2008 | | V1V2V3 nanoparticle circ. permut., inter-subunit disulfide, intra-subunit disulfide, ferritin | Same as Seq_0797 |
| 0810 | F102 | KER2008.12_ds175_320_V1V2V3CAP_fer_10ln_gyc | KER2008 | | Same as Seq_0809 | Same as Seq_0797 |
| 0811 | F103 | KER2008.12_ds175_320_V1V2V3CAP_fer_10ln_gyc | KER2008 | | Same as Seq_0809 | Same as Seq_0797 |
| 0812 | F104 | Q23.17_ds174_319_V1V2V3CAP_fer_15ln_gyc | Q23.17 | | Same as Seq_0809 | Same as Seq_0797 |
| 0813 | F105 | Q23.17_ds174_319_V1V2V3CAP_fer_10ln_gyc | Q23.17 | | Same as Seq_0809 | Same as Seq_0797 |
| 0814 | F106 | Q23.17_ds174_319_V1V2V3CAP_fer_5ln_gyc | Q23.17 | | Same as Seq_0809 | Same as Seq_0797 |
| 0815 | F107 | KER2008.12_ds175_320_V1V2V3CAP_LS_15ln_gyc | KER2008 | | V1V2V3 nanoparticle circ. permut., inter-subunit disulfide, lumazine synthase, intra-subunit disulfide | Same as Seq_0797 |
| 0816 | F108 | KER2008.12_ds175_320_V1V2V3CAP_LS_10ln_gyc | KER2008 | | Same as Seq_0815 | Same as Seq_0797 |
| 0817 | F109 | KER2008.12_ds175_320_V1V2V3CAP_LS_10ln_gyc | KER2008 | | Same as Seq_0815 | Same as Seq_0797 |

| 1 SEQ ID NO | 2 Code | 3 Name | 4 Native Background | 5 Mutations Compared to Native Background | 6 Additional mutations | 7 Comment |
|---|---|---|---|---|---|---|
| 0818 | F110 | Q23.17_ds174_319_V1V2V3CAP_LS_15ln_gyc | Q23.17 | | Same as Seq_0815 | Same as Seq_0797 |
| 0819 | F111 | Q23.17_ds174_319_V1V2V3CAP_LS_10ln_gyc | Q23.17 | | Same as Seq_0815 | Same as Seq_0797 |
| 0820 | F112 | Q23.17_ds174_319_V1V2V3CAP_LS_5ln_gyc | Q23.17 | | Same as Seq_0815 | Same as Seq_0797 |
| 0821 | F113 | BG505_119-136 + ln + 296-331 + ln + 151-205 + 11n + ferr | BG505 | | V1V2V3 nanoparticle circ. permut. | Same as Seq_0797 |
| 0822 | F114 | CNE58_SU-strandC_119-136 + ln + 296-331 + ln + 151-205 + 11n + ferr | CNE58 | | V1V2V3 nanoparticle circ. permut. | Same as Seq_0797 |
| 0823 | F115 | 3301_V1_C24_119-136 + ln + 296-331 + ln + 151-205 + 11n + ferr | 3301 | | V1V2V3 nanoparticle circ. permut. | Same as Seq_0797 |
| 0824 | F116 | ZM53-R166W_119-136 + ln + 296-331 + ln + 151-205 + 11n + ferr | ZM53 | | V1V2V3 nanoparticle circ. permut. | Same as Seq_0797 |
| 0825 | F117 | ZM233.6_119-136 + ln + 296-331 + ln + 151-205 + 11n + ferr | ZM233 | | V1V2V3 nanoparticle circ. permut. | Same as Seq_0797 |
| 0826 | F118 | BG505_119-136 + ln + 296-331 + ln + 151-205 + 5ln + ferr | BG505 | | V1V2V3 nanoparticle circ. permut. | Same as Seq_0797 |
| 0827 | F119 | CNE58_SU-strandC_119-136 + ln + 296-331 + ln + 151-205 + 5ln + ferr | CNE58 | | V1V2V3 nanoparticle circ. permut. | Same as Seq_0797 |
| 0828 | F120 | 3301_V1_C24_119-136 + ln + 296-331 + ln + 151-205 + 5ln + ferr | 3301 | | V1V2V3 nanoparticle circ. permut. | Same as Seq_0797 |
| 0829 | F121 | ZM53-R166W_119-136 + ln + 296-331 + ln + 151-205 + 5ln + ferr | ZM53 | | V1V2V3 nanoparticle circ. permut. | Same as Seq_0797 |
| 0830 | F122 | ZM233.6_119-136 + ln + 296-331 + ln + 151-205 + 5ln + ferr | ZM233 | | V1V2V3 nanoparticle circ. permut. | Same as Seq_0797 |
| 0831 | F123 | BG505_119-136 + ln + 296-331 + ln + 151-205 + 10ln + ferr | BG505 | | V1V2V3 nanoparticle circ. permut. | Same as Seq_0797 |
| 0832 | F124 | CNE58_SU-strandC_119-136 + ln + 296-331 + ln + 151-205 + 10ln + ferr | CNE58 | | V1V2V3 nanoparticle circ. permut. | Same as Seq_0797 |
| 0833 | F125 | 3301_V1_C24_119-136 + ln + 296-331 + ln + 151-205 + 10ln + ferr | 3301 | | V1V2V3 nanoparticle circ. permut. | Same as Seq_0797 |
| 0834 | F126 | ZM53-R166W_119-136 + ln + 296-331 + ln + 151-205 + 10ln + ferr | ZM53 | | V1V2V3 nanoparticle circ. permut. | Same as Seq_0797 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0835 | F127 | ZM233.6_119-136 + ln + 296-331 + ln + 151-205 + 10ln + ferr | ZM233 | | V1V2V3 nanoparticle circ. permut. | Same as Seq_0797 |
| 0836 | E001 | KER2008.12_V1V2V3CAP_1VH8cp_10ln_gyc | KER2008 | | V1V2V3 scaffold circ. permut., inter-subunit disulfide, 1VH8 | Same as Seq_0797 |
| 0837 | E002 | KER2008.12_V1V2V3CAP_1VH8cp_15ln_gyc | KER2008 | | V1V2V3 scaffold circ. permut., inter-subunit disulfide, 1VH8 | Same as Seq_0797 |
| 0838 | E003 | Q23.17_V1V2V3CAP_1VH8cp_10ln_gyc | Q23.17 | | V1V2V3 scaffold circ. permut., inter-subunit disulfide, 1VH8 | Same as Seq_0797 |
| 0839 | E004 | Q23.17_V1V2V3CAP_1VH8cp_15ln_gyc | Q23.17 | | V1V2V3 scaffold circ. permut., inter-subunit disulfide, 1VH8 | Same as Seq_0797 |
| 0840 | E005 | KER2008.12_ds175_320_V1V2V3CAP_1VH8cp_10ln_gyc | KER2008 | | V1V2V3 scaffold circ. permut., inter-subunit disulfide, 1VH8, intra-subunit disulfide | Same as Seq_0797 |
| 0841 | E006 | KER2008.12_ds175_320_V1V2V3CAP_1VH8cp_15ln_gyc | KER2008 | | V1V2V3 scaffold circ. permut., inter-subunit disulfide, 1VH8, intra-subunit disulfide | Same as Seq_0797 |
| 0842 | E007 | Q23.17_ds174_319_V1V2V3CAP_1VH8cp_10ln_gyc | Q23.17 | | V1V2V3 scaffold circ. permut., inter-subunit disulfide, 1VH8, intra-subunit disulfide | Same as Seq_0797 |
| 0843 | E008 | Q23.17_ds174_319_V1V2V3CAP_1VH8cp_15ln_gyc | Q23.17 | | V1V2V3 scaffold circ. permut., inter-subunit disulfide, 1VH8, intra-subunit disulfide | Same as Seq_0797 |
| 0844 | G004 | BG505_119-136 + ln + 296-331 + ln + 151-205 + 3ln + foldon | BG505 | | V1V2V3 trimerization-domain circ. permut. | Same as Seq_0797 |
| 0845 | G005 | CNE58_SU-strandC_119-136 + ln + 296-331 + ln + 151-205 + 3ln + foldon | CNE58 | | V1V2V3 trimerization-domain circ. permut. | Same as Seq_0797 |
| 0846 | G006 | 3301_V1_C24_119-136 + ln + 296-331 + ln + 151-205 + 3ln + foldon | 3301 | | V1V2V3 trimerization-domain circ. permut. | Same as Seq_0797 |

-continued

| SEQ ID NO | Code | Name | Native Background | Mutations Compared to Native Background | Additional mutations | Comment |
|---|---|---|---|---|---|---|
| 0847 | G007 | ZM53-R166W_119-136 + ln + 296-331 + ln + 151-205 + 3ln + foldon | ZM53 | | V1V2V3 trimerization-domain circ. permut. | Same as Seq_0797 |
| 0848 | G008 | ZM233.6_119-136 + ln + 296-331 + ln + 151-205 + 3ln + foldon | ZM233 | | V1V2V3 trimerization-domain circ. permut. | Same as Seq_0797 |
| 0849 | G009 | BG505_119-136 + ln + 296-331 + ln + 151-205 + 7ln + foldon | BG505 | | V1V2V3 trimerization-domain circ. permut. | Same as Seq_0797 |
| 0850 | G010 | CNE58_SU-strandC_119-136 + ln + 296-331 + ln + 151-205 + 7ln + foldon | CNE58 | | V1V2V3 trimerization-domain circ. permut. | Same as Seq_0797 |
| 0851 | G011 | 3301_V1_C24_119-136 + ln + 296-331 + ln + 151-205 + 7ln + foldon | 3301 | | V1V2V3 trimerization-domain circ. permut. | Same as Seq_0797 |
| 0852 | G012 | ZM53-R166W_119-136 + ln + 296-331 + ln + 151-205 + 7ln + foldon | ZM53 | | V1V2V3 trimerization-domain circ. permut. | Same as Seq_0797 |
| 0853 | G013 | ZM233.6_119-136 + ln + 296-331 + ln + 151-205 + 7ln + foldon | ZM233 | | V1V2V3 trimerization-domain circ. permut. | Same as Seq_0797 |
| 0854 | Z | Linker | | | | |
| 0855 | Z | 1VH8 Scaffold | 1VH8 | | | |
| 0856 | H043 | *286.36-chim_d7324.201C-433C | 286.36/BG505 chimera | SOSIP, R6, 664, 201C/433C | Res. 31-45, 478-507, 512-664 from BG505 ("BG505 Platform"), remainder = 286.36 | Same as Seq_0379 |
| 0857 | H044 | 288.38-chim_d7324.201C-433C | 288.38/BG505 chimera | SOSIP, R6, 664, 201C/433C | BG505 Platform, remainder = 288.38 | Same as Seq_0379 |
| 0858 | H045 | 3988.25-chim_d7324.201C-433C | 3988.25/BG505 chimera | SOSIP, R6, 664, 201C/433C | BG505 Platform, remainder = 3988.25 | Same as Seq_0379 |
| 0859 | H046 | 5768.04-chim_d7324.201C-433C | 5768.04/BG505 chimera | SOSIP, R6, 664, 201C/433C | BG505 Platform, remainder from 5768.04 | Same as Seq_0379 |
| 0860 | H047 | 6101.1-chim_d7324.201C-433C | 6101.1/BG505 chimera | SOSIP, R6, 664, 201C/433C | BG505 Platform, remainder = 6101.1 | Same as Seq_0379 |
| 0861 | H048 | 6535.3-chim_d7324.201C-433C | 6535.3/BG505 chimera | SOSIP, R6, 664, 201C/433C | BG505 Platform, remainder = 6535.3 | Same as Seq_0379 |
| 0862 | H049 | 7165.18-chim_d7324.201C-433C | 7165.18/BG505 chimera | SOSIP, R6, 664, 201C/433C | BG505 Platform, remainder = 7165.18 | Same as Seq_0379 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0863 | H050 | 0013095-2.11-chim_d7324.201C-433C | 0013095-2.11/ BG505 chimera | SOSIP, R6, 664, 201C/433C | BG505 Platform, remainder = 0013095-2.11 | Same as Seq_0379 |
| 0864 | H051 | 001428-2.42-chim_d7324.201C-433C | 001428-2.42/ BG505 chimera | SOSIP, R6, 664, 201C/433C | BG505 Platform, remainder = 001428-2.42 | Same as Seq_0379 |
| 0865 | H052 | 0077_V1.C16-chim_d7324.201C-433C | 0077_V1.C16/ BG505 chimera | SOSIP, R6, 664, 201C/433C | BG505 Platform, remainder = 0077V1.C16 | Same as Seq_0379 |
| 0866 | H053 | 00836-2.5-chim_d7324.201C-433C | 00836-2.5/BG505 chimera | SOSIP, R6, 664, 201C/433C | BG505 Platform, remainder = 00836-2.5 | Same as Seq_0379 |
| 0867 | H054 | 0260.v5.c36-chim_d7324.201C-433C | 0260.v5.c36/ BG505 chimera | SOSIP, R6, 664, 201C/433C | BG505 Platform, remainder = 0260.v5.c36 | Same as Seq_0379 |
| 0868 | H055 | 0330.v4.c3-chim_d7324.201C-433C | 0330.v4.c3/ BG505 chimera | SOSIP, R6, 664, 201C/433C | BG505 Platform, remainder = 0330.v4.c3 | Same as Seq_0379 |
| 0869 | H056 | 0439.v5.c1-chim_d7324.201C-433C | 0439.v5.c1/ BG505 chimera | SOSIP, R6, 664, 201C/433C | BG505 Platform, remainder = 0439.v5.c1 | Same as Seq_0379 |
| 0870 | H057 | 0815.V3.C3-chim_d7324.201C-433C | 0815.V3.C3/ BG505 chimera | SOSIP, R6, 664, 201C/433C | BG505 Platform, remainder = 0815.V3.C3 | Same as Seq_0379 |
| 0871 | H058 | *0921.V2.C14-chim_d7324.201C-433C | 0921.V2.C14/ BG505 chimera | SOSIP, R6, 664, 201C/433C | BG505 Platform, remainder = 0921.V2.C14 | Same as Seq_0379 |
| 0872 | H059 | *16055-2.3-chim_d7324.201C-433C | 16055-2.3/BG505 chimera | SOSIP, R6, 664, 201C/433C | BG505 Platform, remainder = 16055-2.3 | Same as Seq_0379 |
| 0873 | H060 | 16845-2.22-chim_d7324.201C-433C | 16845-2.22/BG505 chimera | SOSIP, R6, 664, 201C/433C | BG505 Platform, remainder = 16845-2.22 | Same as Seq_0379 |
| 0874 | H061 | 16936-2.21-chim_d7324.201C-433C | 16936-2.21/BG505 chimera | SOSIP, R6, 664, 201C/433C | BG505 Platform, remainder = 16936-2.21 | Same as Seq_0379 |
| 0875 | H062 | 231965.c1-chim_d7324.201C-433C | 231965.c1/BG505 chimera | SOSIP, R6, 664, 201C/433C | BG505 Platform, remainder = 231965.c1 | Same as Seq_0379 |
| 0876 | H063 | 235-47-chim_d7324.201C-433C | 235-47/BG505 chimera | SOSIP, R6, 664, 201C/433C | BG505 Platform, remainder = 235-47 | Same as Seq_0379 |
| 0877 | H064 | 242-14-chim_d7324.201C-433C | 242-14/BG505 chimera | SOSIP, R6, 664, 201C/433C | BG505 Platform, remainder = 242-14 | Same as Seq_0379 |
| 0878 | H065 | 247-23-chim_d7324.201C-433C | 247-23/BG505 chimera | SOSIP, R6, 664, 201C/433C | BG505 Platform, remainder = 247-23 | Same as Seq_0379 |

| 1 SEQ ID NO | 2 Code | 3 Name | 4 Native Background | 5 Mutations Compared to Native Background | 6 Additional mutations | 7 Comment |
|---|---|---|---|---|---|---|
| 0879 | H066 | 25710-2.43-chim_d7324.201C-433C | 25710-2.43/BG505 chimera | SOSIP, R6, 664, 201C/433C | BG505 Platform, remainder = 25710-2.43 | Same as Seq_0379 |
| 0880 | H067 | 25711-2.4-chim_d7324.201C-433C | 25711-2.4/BG505 chimera | SOSIP, R6, 664, 201C/433C | BG505 Platform, remainder = 25711-2.4 | Same as Seq_0379 |
| 0881 | H068 | *25925-2.22-chim_d7324.201C-433C | 25925-2.22/BG505 chimera | SOSIP, R6, 664, 201C/433C | BG505 Platform, remainder = 25925-2.22 | Same as Seq_0379 |
| 0882 | H069 | 26191-2.48-chim_d7324.201C-433C | 26191-2.48/BG505 chimera | SOSIP, R6, 664, 201C/433C | BG505 Platform, remainder = 26191-2.48 | Same as Seq_0379 |
| 0883 | H070 | 263-8-chim_d7324.201C-433C | 263-8/BG505 chimera | SOSIP, R6, 664, 201C/433C | BG505 Platform, remainder = 263-8 | Same as Seq_0379 |
| 0884 | H071 | 269-12-chim_d7324.201C-433C | 269-12/BG505 chimera | SOSIP, R6, 664, 201C/433C | BG505 Platform, remainder = 269-12 | Same as Seq_0379 |
| 0885 | H072 | 271-11-chim_d7324.201C-433C | 271-11/BG505 chimera | SOSIP, R6, 664, 201C/433C | BG505 Platform, remainder = 271-11 | Same as Seq_0379 |
| 0886 | H073 | 3016.v5.c45-chim_d7324.201C-433C | 3016.v5.c45/BG505 chimera | SOSIP, R6, 664, 201C/433C | BG505 Platform, remainder = 3016.v5.c45 | Same as Seq_0379 |
| 0887 | H074 | 3168.V4.C10-chim_d7324.201C-433C | 3168.V4.C10/BG505 chimera | SOSIP, R6, 664, 201C/433C | BG505 Platform, remainder = 3168.V4.C10 | Same as Seq_0379 |
| 0888 | H075 | *3301.V1.C24-chim_d7324.201C-433C | 3301.V1.C24/BG505 chimera | SOSIP, R6, 664, 201C/433C | BG505 Platform, remainder = 3301.V1.C24 | Same as Seq_0379 |
| 0889 | H076 | 3326.V4.C3-chim_d7324.201C-433C | 3326.V4.C3/BG505 chimera | SOSIP, R6, 664, 201C/433C | BG505 Platform, remainder = 3326.V4.C3 | Same as Seq_0379 |
| 0890 | H077 | 3337.V2.C6-chim_d7324.201C-433C | 3337.V2.C6/BG505 chimera | SOSIP, R6, 664, 201C/433C | BG505 Platform, remainder = 3337.V2.C6 | Same as Seq_0379 |
| 0891 | H078 | 3365.v2.c20-chim_d7324.201C-433C | 3365.v2.c20/BG505 chimera | SOSIP, R6, 664, 201C/433C | BG505 Platform, remainder = 3365.v2.c20 | Same as Seq_0379 |
| 0892 | H079 | 3415.v1.c1-chim_d7324.201C-433C | 3415.v1.c1/BG505 chimera | SOSIP, R6, 664, 201C/433C | BG505 Platform, remainder = 3415.v1.c1 | Same as Seq_0379 |
| 0893 | H080 | 3468.V1.C12-chim_d7324.201C-433C | 3468.V1.C12/BG505 chimera | SOSIP, R6, 664, 201C/433C | BG505 Platform, remainder = 3468.V1.C12 | Same as Seq_0379 |
| 0894 | H081 | 3589.V1.C4-chim_d7324.201C-433C | 3589.V1.C4/BG505 chimera | SOSIP, R6, 664, 201C/433C | BG505 Platform, remainder = 3589.V1.C4 | Same as Seq_0379 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0895 | H082 | 3637.V5.C3-chim_d7324.201C-433C | 3637.V5.C3/BG505 chimera | SOSIP, R6, 664, 201C/433C | BG505 Platform, remainder = 3637.V5.C3 | Same as Seq_0379 |
| 0896 | H083 | 3718.v3.c11-chim_d7324.201C-433C | 3718.v3.c11/BG505 chimera | SOSIP, R6, 664, 201C/433C | BG505 Platform, remainder = 3718.v3.c11 | Same as Seq_0379 |
| 0897 | H084 | 3817.v2.c59-chim_d7324.201C-433C | 3817.v2.c59/BG505 chimera | SOSIP, R6, 664, 201C/433C | BG505 Platform, remainder = 3817.v2.c59 | Same as Seq_0379 |
| 0898 | H085 | 3873.V1.C24-chim_d7324.201C-433C | 3873.V1.C24/BG505 chimera | SOSIP, R6, 664, 201C/433C | BG505 Platform, remainder = 3873.V1.C24 | Same as Seq_0379 |
| 0899 | H086 | 398-F1_F6_20-chim_d7324.201C-433C | 398-F1_F6_20/BG505 chimera | SOSIP, R6, 664, 201C/433C | BG505 Platform, remainder = 398-F1_F6_20 | Same as Seq_0379 |
| 0900 | H087 | 57128.vrc15-chim_d7324.201C-433C | 57128.vrc15/BG505 chimera | SOSIP, R6, 664, 201C/433C | BG505 Platform, remainder = 57128.vrc15 | Same as Seq_0379 |
| 0901 | H088 | 6095.V1.C10-chim_d7324.201C-433C | 6095.V1.C10/BG505 chimera | SOSIP, R6, 664, 201C/433C | BG505 Platform, remainder = 6095.V1.C10 | Same as Seq_0379 |
| 0902 | H089 | *620345.c1-chim_d7324.201C-433C | 620345.c1/BG505 chimera | SOSIP, R6, 664, 201C/433C | BG505 Platform, remainder = 620345.c1 | Same as Seq_0379 |
| 0903 | H090 | 6322.V4.C1-chim_d7324.201C-433C | 6322.V4.C1/BG505 chimera | SOSIP, R6, 664, 201C/433C | BG505 Platform, remainder = 6322.V4.C1 | Same as Seq_0379 |
| 0904 | H091 | 6405.v4.c34-chim_d7324.201C-433C | 6405.v4.c34/BG505 chimera | SOSIP, R6, 664, 201C/433C | BG505 Platform, remainder = 6405.v4.c34 | Same as Seq_0379 |
| 0905 | H092 | 6471.V1.C16-chim_d7324.201C-433C | 6471.V1.C16/BG505 chimera | SOSIP, R6, 664, 201C/433C | BG505 Platform, remainder = 6471.V1.C16 | Same as Seq_0379 |
| 0906 | H093 | 6540.v4.c1-chim_d7324.201C-433C | 6540.v4.c1/BG505 chimera | SOSIP, R6, 664, 201C/433C | BG505 Platform, remainder = 6540.v4.c1 | Same as Seq_0379 |
| 0907 | H094 | 6545.V3.C13-chim_d7324.201C-433C | 6545.V3.C13/BG505 chimera | SOSIP, R6, 664, 201C/433C | BG505 Platform, remainder = 6545.V3.C13 | Same as Seq_0379 |
| 0908 | H095 | 6545.V4.C1-chim_d7324.201C-433C | 6545.V4.C1/BG505 chimera | SOSIP, R6, 664, 201C/433C | BG505 Platform, remainder = 6545.V4.C1 | Same as Seq_0379 |
| 0909 | H096 | 6631.V3.C10-chim_d7324.201C-433C | 6631.V3.C10/BG505 chimera | SOSIP, R6, 664, 201C/433C | BG505 Platform, remainder = 6631.V3.C10 | Same as Seq_0379 |
| 0910 | H097 | 6644.V2.C33-chim_d7324.201C-433C | 6644.V2.C33/BG505 chimera | SOSIP, R6, 664, 201C/433C | BG505 Platform, remainder = 6644.V2.C33 | Same as Seq_0379 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0911 | H098 | 6785.V5.C14-chim_d7324.201C-433C | 6785.V5.C14/BG505 chimera | SOSIP, R6, 664, 201C/433C | BG505 Platform, remainder = 6785.V5.C14 | Same as Seq_0379 |
| 0912 | H099 | 6838.V1.C35-chim_d7324.201C-433C | 6838.V1.C35/BG505 chimera | SOSIP, R6, 664, 201C/433C | BG505 Platform, remainder = 6838.V1.C35 | Same as Seq_0379 |
| 0913 | H100 | 89.6.DG-chim_d7324.201C-433C | 89.6.DG/BG505 chimera | SOSIP, R6, 664, 201C/433C | BG505 Platform, remainder = 89.6.DG | Same as Seq_0379 |
| 0914 | H101 | 928-28-chim_d7324.201C-433C | 928-28/BG505 chimera | SOSIP, R6, 664, 201C/433C | BG505 Platform, remainder = 928-28 | Same as Seq_0379 |
| 0915 | H102 | 962M651.02-chim_d7324.201C-433C | 962M651.02/BG505 chimera | SOSIP, R6, 664, 201C/433C | BG505 Platform, remainder = 962M651.02 | Same as Seq_0379 |
| 0916 | H103 | A03349M1.vrc4a-chim_d7324.201C-433C | A03349M1.vrc4a/BG505 chimera | SOSIP, R6, 664, 201C/433C | BG505 Platform, remainder = A03349M1.vrc4a | Same as Seq_0379 |
| 0917 | H104 | *AC10.29-chim_d7324.201C-433C | AC10.29/BG505 chimera | SOSIP, R6, 664, 201C/433C | BG505 Platform, remainder = AC10.29 | Same as Seq_0379 |
| 0918 | H105 | ADA.DG-chim_d7324.201C-433C | ADA.DG/BG505 chimera | SOSIP, R6, 664, 201C/433C | BG505 Platform, remainder = ADA.DG | Same as Seq_0379 |
| 0919 | H106 | Bal.01-chim_d7324.201C-433C | Bal.01/BG505 chimera | SOSIP, R6, 664, 201C/433C | BG505 Platform, remainder = Bal.01 | Same as Seq_0379 |
| 0920 | H107 | BaL.26-chim_d7324.201C-433C | BaL.26/BG505 chimera | SOSIP, R6, 664, 201C/433C | BG505 Platform, remainder = BaL.26 | Same as Seq_0379 |
| 0921 | H108 | BB201.1342-chim_d7324.201C-433C | BB201.1342/BG505 chimera | SOSIP, R6, 664, 201C/433C | BG505 Platform, remainder = BB201.B42 | Same as Seq_0379 |
| 0922 | H109 | BB539.21313-chim_d7324.201C-433C | BB539.21313/BG505 chimera | SOSIP, R6, 664, 201C/433C | BG505 Platform, remainder = B13539.21313 | Same as Seq_0379 |
| 0923 | H110 | BG1168.01-chim_d7324.201C-433C | BG1168.01/BG505 chimera | SOSIP, R6, 664, 201C/433C | BG505 Platform, remainder = BG1168.01 | Same as Seq_0379 |
| 0924 | H111 | *B1369.9A-chim_d7324.201C-433C | B1369.9A/BG505 chimera | SOSIP, R6, 664, 201C/433C | BG505 Platform, remainder = B1369.9A | Same as Seq_0379 |
| 0925 | H112 | BL01.DG-chim_d7324.201C-433C | BL01.DG/BG505 chimera | SOSIP, R6, 664, 201C/433C | BG505 Platform, remainder = BL01.DG | Same as Seq_0379 |
| 0926 | H113 | BR025.9-chim_d7324.201C-433C | BR025.9/BG505 chimera | SOSIP, R6, 664, 201C/433C | BG505 Platform, remainder = BR025.9 | Same as Seq_0379 |

| 1 SEQ ID NO | 2 Code | 3 Name | 4 Native Background | 5 Mutations Compared to Native Background | 6 Additional mutations | 7 Comment |
|---|---|---|---|---|---|---|
| 0927 | H114 | BR07.DG-chim_d7324.201C-433C | BR07.DG/BG505 chimera | SOSIP, R6, 664, 201C/433C | BG505 Platform, remainder = BR07.DG | Same as Seq_0379 |
| 0928 | H115 | BS208.131-chim_d7324.201C-433C | BS208.131/BG505 chimera | SOSIP, R6, 664, 201C/433C | BG505 Platform, remainder = BS208.61 | Same as Seq_0379 |
| 0929 | H116 | BX08.16-chim_d7324.201C-433C | BX08.16/BG505 chimera | SOSIP, R6, 664, 201C/433C | BG505 Platform, remainder = BX08.16 | Same as Seq_0379 |
| 0930 | H117 | *C1080.c3-chim_d7324.201C-433C | C1080.c3/BG505 chimera | SOSIP, R6, 664, 201C/433C | BG505 Platform, remainder = C1080.c3 | Same as Seq_0379 |
| 0931 | H118 | C2101.c1-chim_d7324.201C-433C | C2101.c1/BG505 chimera | SOSIP, R6, 664, 201C/433C | BG505 Platform, remainder = C2101.c1 | Same as Seq_0379 |
| 0932 | H119 | C3347.c11-chim_d7324.201C-433C | C3347.c11/BG505 chimera | SOSIP, R6, 664, 201C/433C | BG505 Platform, remainder = C3347.c11 | Same as Seq_0379 |
| 0933 | H120 | *C4118.09-chim_d7324.201C-433C | C4118.09/BG505 chimera | SOSIP, R6, 664, 201C/433C | BG505 Platform, remainder = C4118.09 | Same as Seq_0379 |
| 0934 | H121 | CAAN.A2-chim_d7324.201C-433C | CAAN.A2/BG505 chimera | SOSIP, R6, 664, 201C/433C | BG505 Platform, remainder = CAAN.A2 | Same as Seq_0379 |
| 0935 | H122 | CAP210.E8-chim_d7324.201C-433C | CAP210.E8/BG505 chimera | SOSIP, R6, 664, 201C/433C | BG505 Platform, remainder = CAP210.E8 | Same as Seq_0379 |
| 0936 | H123 | CAP244.D3-chim_d7324.201C-433C | CAP244.D3/BG505 chimera | SOSIP, R6, 664, 201C/433C | BG505 Platform, remainder = CAP244.D3 | Same as Seq_0379 |
| 0937 | H124 | *CAP45.G3-chim_d7324.201C-433C | CAP45.G3/BG505 chimera | SOSIP, R6, 664, 201C/433C | BG505 Platform, remainder = CAP45.G3 | Same as Seq_0379 |
| 0938 | H125 | *CH038.12-chim_d7324.201C-433C | CH038.12/BG505 chimera | SOSIP, R6, 664, 201C/433C | BG505 Platform, remainder = CH038.12 | Same as Seq_0379 |
| 0939 | H126 | CH070.1-chim_d7324.201C-433C | CH070.1/BG505 chimera | SOSIP, R6, 664, 201C/433C | BG505 Platform, remainder = CH070.1 | Same as Seq_0379 |
| 0940 | H127 | *CH117.4-chim_d7324.201C-433C | CH117.4/BG505 chimera | SOSIP, R6, 664, 201C/433C | BG505 Platform, remainder = CH117.4 | Same as Seq_0379 |
| 0941 | H128 | CH181.12-chim_d7324.201C-433C | CH181.12/BG505 chimera | SOSIP, R6, 664, 201C/433C | BG505 Platform, remainder = CH181.12 | Same as Seq_0379 |
| 0942 | H129 | CNE10-chim_d7324.201C-433C | CNE10/BG505 chimera | SOSIP, R6, 664, 201C/433C | BG505 Platform, remainder = CNE1 | Same as Seq_0379 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0943 | H130 | CNE12-chim_d7324.201C-433C | CNE12/BG505 chimera | SOSIP, R6, 664, 201C/433C | BG505 Platform, remainder = CNE12 | Same as Seq_0379 |
| 0944 | H131 | CNE14-chim_d7324.201C-433C | CNE14/BG505 chimera | SOSIP, R6, 664, 201C/433C | BG505 Platform, remainder = CNE14 | Same as Seq_0379 |
| 0945 | H132 | CNE15-chim_d7324.201C-433C | CNE15/BG505 chimera | SOSIP, R6, 664, 201C/433C | BG505 Platform, remainder = CNE15 | Same as Seq_0379 |
| 0946 | H133 | CNE3-chim_d7324.201C-433C | CNE3/BG505 chimera | SOSIP, R6, 664, 201C/433C | BG505 Platform, remainder = CNE3 | Same as Seq_0379 |
| 0947 | H134 | CNE30-chim_d7324.201C-433C | CNE30/BG505 chimera | SOSIP, R6, 664, 201C/433C | BG505 Platform, remainder = CNE30 | Same as Seq_0379 |
| 0948 | H135 | CNE31-chim_d7324.201C-433C | CNE31/BG505 chimera | SOSIP, R6, 664, 201C/433C | BG505 Platform, remainder = CNE31 | Same as Seq_0379 |
| 0949 | H136 | CNE4-chim_d7324.201C-433C | CNE4/BG505 chimera | SOSIP, R6, 664, 201C/433C | BG505 Platform, remainder = CNE4 | Same as Seq_0379 |
| 0950 | H137 | CNE40-chim_d7324.201C-433C | CNE40/BG505 chimera | SOSIP, R6, 664, 201C/433C | BG505 Platform, remainder = CNE40 | Same as Seq_0379 |
| 0951 | H138 | CNE5-chim_d7324.201C-433C | CNE5/BG505 chimera | SOSIP, R6, 664, 201C/433C | BG505 Platform, remainder = CNE5 | Same as Seq_0379 |
| 0952 | H139 | CNE53-chim_d7324.201C-433C | CNE53/BG505 chimera | SOSIP, R6, 664, 201C/433C | BG505 Platform, remainder = CNE53 | Same as Seq_0379 |
| 0953 | H140 | *CNE55-chim_d7324.201C-433C | CNE55/BG505 chimera | SOSIP, R6, 664, 201C/433C | BG505 Platform, remainder = CNE55 | Same as Seq_0379 |
| 0954 | H141 | CNE56-chim_d7324.201C-433C | CNE56/BG505 chimera | SOSIP, R6, 664, 201C/433C | BG505 Platform, remainder = CNE56 | Same as Seq_0379 |
| 0955 | H142 | CNE57-chim_d7324.201C-433C | CNE57/BG505 chimera | SOSIP, R6, 664, 201C/433C | BG505 Platform, remainder = CNE57 | Same as Seq_0379 |
| 0956 | H143 | CNE58-chim_d7324.201C-433C | CNE58/BG505 chimera | SOSIP, R6, 664, 201C/433C | BG505 Platform, remainder = CNE58 | Same as Seq_0379 |
| 0957 | H144 | CNE59-chim_d7324.201C-433C | CNE59/BG505 chimera | SOSIP, R6, 664, 201C/433C | BG505 Platform, remainder = CNE59 | Same as Seq_0379 |
| 0958 | H145 | CNE7-chim_d7324.201C-433C | CNE7/BG505 chimera | SOSIP, R6, 664, 201C/433C | BG505 Platform, remainder = CNE7 | Same as Seq_0379 |

| 1 SEQ ID NO | 2 Code | 3 Name | 4 Native Background | 5 Mutations Compared to Native Background | 6 Additional mutations | 7 Comment |
|---|---|---|---|---|---|---|
| 0959 | H146 | DJ263.8-chim_d7324.201C-433C | DJ263.8/BG505 chimera | SOSIP, R6, 664, 201C/433C | BG505 Platform, remainder = DJ263.8 | Same as Seq_0379 |
| 0960 | H147 | DU123.06-chim_d7324.201C-433C | DU123.06/BG505 chimera | SOSIP, R6, 664, 201C/433C | BG505 Platform, remainder = DU123.06 | Same as Seq_0379 |
| 0961 | H148 | DU151.02-chim_d7324.201C-433C | DU151.02/BG505 chimera | SOSIP, R6, 664, 201C/433C | BG505 Platform, remainder = DU151.02 | Same as Seq_0379 |
| 0962 | H149 | *DU156.12-chim_d7324.201C-433C | DU156.12/BG505 chimera | SOSIP, R6, 664, 201C/433C | BG505 Platform, remainder = DU156.12 | Same as Seq_0379 |
| 0963 | H150 | DU172.17-chim_d7324.201C-433C | DU172.17/BG505 chimera | SOSIP, R6, 664, 201C/433C | BG505 Platform, remainder = DU172.17 | Same as Seq_0379 |
| 0964 | H151 | *DU422.01-chim_d7324.201C-433C | DU422.01/BG505 chimera | SOSIP, R6, 664, 201C/433C | BG505 Platform, remainder = DU422.01 | Same as Seq_0379 |
| 0965 | H152 | H086.8-chim_d7324.201C-433C | H086.8/BG505 chimera | SOSIP, R6, 664, 201C/433C | BG505 Platform, remainder = H086.8 | Same as Seq_0379 |
| 0966 | H153 | HT593.1-chim_d7324.201C-433C | HT593.1/BG505 chimera | SOSIP, R6, 664, 201C/433C | BG505 Platform, remainder = HT593.1 | Same as Seq_0379 |
| 0967 | H154 | JRCSF.JB-chim_d7324.201C-433C | JRCSF.JB/BG505 chimera | SOSIP, R6, 664, 201C/433C | BG505 Platform, remainder = JRCSF.JB | Same as Seq_0379 |
| 0968 | H155 | JRFLIB-chim_d7324.201C-433C | JRFL.JB/BG505 chimera | SOSIP, R6, 664, 201C/433C | BG505 Platform, remainder = JRFL.JB | Same as Seq_0379 |
| 0969 | H156 | KER2008.12-chim_d7324.201C-433C | KER2008.12/BG505 chimera | SOSIP, R6, 664, 201C/433C | BG505 Platform, remainder = KER2008.12 | Same as Seq_0379 |
| 0970 | H157 | KER2018.11-chim_d7324.201C-433C | KER2018.11/BG505 chimera | SOSIP, R6, 664, 201C/433C | BG505 Platform, remainder = KER2018.11 | Same as Seq_0379 |
| 0971 | H158 | KNH1209.18-chim_d7324.201C-433C | KNH1209.18/BG505 chimera | SOSIP, R6, 664, 201C/433C | BG505 Platform, remainder = KNH1209.18 | Same as Seq_0379 |
| 0972 | H159 | M02138-chim_d7324.201C-433C | M02138/BG505 chimera | SOSIP, R6, 664, 201C/433C | BG505 Platform, remainder = M02138 | Same as Seq_0379 |
| 0973 | H160 | *MB201.A1-chim_d7324.201C-433C | MB201.A1/BG505 chimera | SOSIP, R6, 664, 201C/433C | BG505 Platform, remainder = MB201.A1 | Same as Seq_0379 |
| 0974 | H161 | MB539.2137-chim_d7324.201C-433C | MB539.2137/BG505 chimera | SOSIP, R6, 664, 201C/433C | BG505 Platform, remainder = MB539.267 | Same as Seq_0379 |

| 1 SEQ ID NO | 2 Code | 3 Name | 4 Native Background | 5 Mutations Compared to Native Background | 6 Additional mutations | 7 Comment |
|---|---|---|---|---|---|---|
| 0975 | H162 | MI369.A5-chim_d7324.201C-433C | MI369.A5/BG505 chimera | SOSIP, R6, 664, 201C/433C | BG505 Platform, remainder = MI369.A5 | Same as Seq_0379 |
| 0976 | H163 | MN.3-chim_d7324.201C-433C | MN.3/BG505 chimera | SOSIP, R6, 664, 201C/433C | BG505 Platform, remainder = MN.3 | Same as Seq_0379 |
| 0977 | H164 | M5208.A1-chim_d7324.201C-433C | M5208.A1/BG505 chimera | SOSIP, R6, 664, 201C/433C | BG505 Platform, remainder = M5208.A1 | Same as Seq_0379 |
| 0978 | H165 | *MW965.26-chim_d7324.201C-433C | MW965.26/BG505 chimera | SOSIP, R6, 664, 201C/433C | BG505 Platform, remainder = MW965.26 | Same as Seq_0379 |
| 0979 | H166 | NKU3006.ec1-chim_d7324.201C-433C | NKU3006.ec1/BG505 chimera | SOSIP, R6, 664, 201C/433C | BG505 Platform, remainder = NKU3006.ec1 | Same as Seq_0379 |
| 0980 | H167 | PVO.04-chim_d7324.201C-433C | PVO.04/BG505 chimera | SOSIP, R6, 664, 201C/433C | BG505 Platform, remainder = PVO.04 | Same as Seq_0379 |
| 0981 | H168 | Q168.a2-chim_d7324.201C-433C | Q168.a2/BG505 chimera | SOSIP, R6, 664, 201C/433C | BG505 Platform, remainder = Q168.a2 | Same as Seq_0379 |
| 0982 | H169 | Q23.17-chim_d7324.201C-433C | Q23.17/BG505 chimera | SOSIP, R6, 664, 201C/433C | BG505 Platform, remainder = Q23.17 | Same as Seq_0379 |
| 0983 | H170 | Q259.17-chim_d7324.201C-433C | Q259.17/BG505 chimera | SOSIP, R6, 664, 201C/433C | BG505 Platform, remainder = Q259.17 | Same as Seq_0379 |
| 0984 | H171 | Q461.e2-chim_d7324.201C-433C | Q461.e2/BG505 chimera | SOSIP, R6, 664, 201C/433C | BG505 Platform, remainder = Q461.e2 | Same as Seq_0379 |
| 0985 | H172 | Q769.d22-chim_d7324.201C-433C | Q769.d22/BG505 chimera | SOSIP, R6, 664, 201C/433C | BG505 Platform, remainder = Q769.d22 | Same as Seq_0379 |
| 0986 | H173 | Q769.h5-chim_d7324.201C-433C | Q769.h5/BG505 chimera | SOSIP, R6, 664, 201C/433C | BG505 Platform, remainder = Q769.h5 | Same as Seq_0379 |
| 0987 | H174 | Q842.d12-chim_d7324.201C-433C | Q842.d12/BG505 chimera | SOSIP, R6, 664, 201C/433C | BG505 Platform, remainder = Q842.d12 | Same as Seq_0379 |
| 0988 | H175 | QH0515.01-chim_d7324.201C-433C | QH0515.01/BG505 chimera | SOSIP, R6, 664, 201C/433C | BG505 Platform, remainder = QH0515.01 | Same as Seq_0379 |
| 0989 | H176 | QH0692.42-chim_d7324.201C-433C | QH0692.42/BG505 chimera | SOSIP, R6, 664, 201C/433C | BG505 Platform, remainder = QH0692.42 | Same as Seq_0379 |
| 0990 | H177 | *QH209.14M.A2-chim_d7324.201C-433C | QH209.14M.A2/BG505 chimera | SOSIP, R6, 664, 201C/433C | BG505 Platform, remainder = QH209.14M.A2 | Same as Seq_0379 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 0991 | H178 | R1166.c1-chim_d7324.201C-433C | R1166.c1/BG505 chimera | SOSIP, R6, 664, 201C/433C | BG505 Platform, remainder = R1166.c1 | Same as Seq_0379 |
| 0992 | H179 | R2184.c4-chim_d7324.201C-433C | R2184.c4/BG505 chimera | SOSIP, R6, 664, 201C/433C | BG505 Platform, remainder = R2184.c4 | Same as Seq_0379 |
| 0993 | H180 | R3265.c6-chim_d7324.201C-433C | R3265.c6/BG505 chimera | SOSIP, R6, 664, 201C/433C | BG505 Platform, remainder = R3265.c6 | Same as Seq_0379 |
| 0994 | H181 | REJO.67-chim_d7324.201C-433C | REJO.67/BG505 chimera | SOSIP, R6, 664, 201C/433C | BG505 Platform, remainder = REJO.67 | Same as Seq_0379 |
| 0995 | H182 | RHPA.7-chim_d7324.201C-433C | RHPA.7/BG505 chimera | SOSIP, R6, 664, 201C/433C | BG505 Platform, remainder = RHPA.7 | Same as Seq_0379 |
| 0996 | H183 | RWO20.2-chim_d7324.201C-433C | RWO20.2/BG505 chimera | SOSIP, R6, 664, 201C/433C | BG505 Platform, remainder = RWO20.2 | Same as Seq_0379 |
| 0997 | H184 | SC422.8-chim_d7324.201C-433C | SC422.8/BG505 chimera | SOSIP, R6, 664, 201C/433C | BG505 Platform, remainder = SC422.8 | Same as Seq_0379 |
| 0998 | H185 | SF162.LS-chim_d7324.201C-433C | SF162.LS/BG505 chimera | SOSIP, R6, 664, 201C/433C | BG505 Platform, remainder = SF162.LS | Same as Seq_0379 |
| 0999 | H186 | SO18.18-chim_d7324.201C-433C | SO18.18/BG505 chimera | SOSIP, R6, 664, 201C/433C | BG505 Platform, remainder = SO18.18 | Same as Seq_0379 |
| 1000 | H187 | SS1196.01-chim_d7324.201C-433C | SS1196.01/BG505 chimera | SOSIP, R6, 664, 201C/433C | BG505 Platform, remainder = SS1196.01 | Same as Seq_0379 |
| 1001 | H188 | T250-4-chim_d7324.201C-433C | T250-4/BG505 chimera | SOSIP, R6, 664, 201C/433C | BG505 Platform, remainder = T250-4 | Same as Seq_0379 |
| 1002 | H189 | T251-18-chim_d7324.201C-433C | T251-18/BG505 chimera | SOSIP, R6, 664, 201C/433C | BG505 Platform, remainder = T251-18 | Same as Seq_0379 |
| 1003 | H190 | T253-11-chim_d7324.201C-433C | T253-11/BG505 chimera | SOSIP, R6, 664, 201C/433C | BG505 Platform, remainder = T253-11 | Same as Seq_0379 |
| 1004 | H191 | T255-34-chim_d7324.201C-433C | T255-34/BG505 chimera | SOSIP, R6, 664, 201C/433C | BG505 Platform, remainder = T255-34 | Same as Seq_0379 |
| 1005 | H192 | T257-31-chim_d7324.201C-433C | T257-31/BG505 chimera | SOSIP, R6, 664, 201C/433C | BG505 Platform, remainder = T257-31 | Same as Seq_0379 |
| 1006 | H193 | T266-60-chim_d7324.201C-433C | T266-60/BG505 chimera | SOSIP, R6, 664, 201C/433C | BG505 Platform, remainder = T266-60 | Same as Seq_0379 |

| 1 SEQ ID NO | 2 Code | 3 Name | 4 Native Background | 5 Mutations Compared to Native Background | 6 Additional mutations | 7 Comment |
|---|---|---|---|---|---|---|
| 1007 | H194 | T278-50-chim_d7324.201C-433C | T278-50/BG505 chimera | SOSIP, R6, 664, 201C/433C | BG505 Platform, remainder = T278-50 | Same as Seq_0379 |
| 1008 | H195 | T280-5-chim_d7324.201C-433C | T280-5/BG505 chimera | SOSIP, R6, 664, 201C/433C | BG505 Platform, remainder = T280-5 | Same as Seq_0379 |
| 1009 | H196 | T33-7-chim_d7324.201C-433C | T33-7/BG505 chimera | SOSIP, R6, 664, 201C/433C | BG505 Platform, remainder = T33-7 | Same as Seq_0379 |
| 1010 | H197 | *TH966.8-chim_d7324.201C-433C | TH966.8/BG505 chimera | SOSIP, R6, 664, 201C/433C | BG505 Platform, remainder = TH966.8 | Same as Seq_0379 |
| 1011 | H198 | TH976.17-chim_d7324.201C-433C | TH976.17/BG505 chimera | SOSIP, R6, 664, 201C/433C | BG505 Platform, remainder = TH976.17 | Same as Seq_0379 |
| 1012 | H199 | THRO.18-chim_d7324.201C-433C | THRO.18/BG505 chimera | SOSIP, R6, 664, 201C/433C | BG505 Platform, remainder = THRO.18 | Same as Seq_0379 |
| 1013 | H200 | TRJO.58-chim_d7324.201C-433C | TRJO.58/BG505 chimera | SOSIP, R6, 664, 201C/433C | BG505 Platform, remainder = TRJO.58 | Same as Seq_0379 |
| 1014 | H201 | TRO.11-chim_d7324.201C-433C | TRO.11/BG505 chimera | SOSIP, R6, 664, 201C/433C | BG505 Platform, remainder = TRO.11 | Same as Seq_0379 |
| 1015 | H202 | TV1.29-chim_d7324.201C-433C | TV1.29/BG505 chimera | SOSIP, R6, 664, 201C/433C | BG505 Platform, remainder = TV1.29 | Same as Seq_0379 |
| 1016 | H203 | TZA125.17-chim_d7324.201C-433C | TZA125.17/BG505 chimera | SOSIP, R6, 664, 201C/433C | BG505 Platform, remainder = TZA125.17 | Same as Seq_0379 |
| 1017 | H204 | TZBD.02-chim_d7324.201C-433C | TZBD.02/BG505 chimera | SOSIP, R6, 664, 201C/433C | BG505 Platform, remainder = TZBD.02 | Same as Seq_0379 |
| 1018 | H205 | UG021.16-chim_d7324.201C-433C | UG021.16/BG505 chimera | SOSIP, R6, 664, 201C/433C | BG505 Platform, remainder = UG021.16 | Same as Seq_0379 |
| 1019 | H206 | UG024.2-chim_d7324.201C-433C | UG024.2/BG505 chimera | SOSIP, R6, 664, 201C/433C | BG505 Platform, remainder = UG024.2 | Same as Seq_0379 |
| 1020 | H207 | UG037.8-chim_d7324.201C-433C | UG037.8/BG505 chimera | SOSIP, R6, 664, 201C/433C | BG505 Platform, remainder = UG037.8 | Same as Seq_0379 |
| 1021 | H208 | WITO.33-chim_d7324.201C-433C | WITO.33/BG505 chimera | SOSIP, R6, 664, 201C/433C | BG505 Platform, remainder = WITO.33 | Same as Seq_0379 |
| 1022 | H209 | X2088.c9-chim_d7324.201C-433C | X2088.c9/BG505 chimera | SOSIP, R6, 664, 201C/433C | BG505 Platform, remainder = X2088.c9 | Same as Seq_0379 |

| 1 SEQ ID NO | 2 Code | 3 Name | 4 Native Background | 5 Mutations Compared to Native Background | 6 Additional mutations | 7 Comment |
|---|---|---|---|---|---|---|
| 1023 | H210 | YU2.DG-chim_d7324.201C-433C | YU2.DG/BG505 chimera | SOSIP, R6, 664, 201C/433C | BG505 Platform, remainder = YU2.DG | Same as Seq_0379 |
| 1024 | H211 | ZA012.29-chim_d7324.201C-433C | ZA012.29/BG505 chimera | SOSIP, R6, 664, 201C/433C | BG505 Platform, remainder = ZA012.29 | Same as Seq_0379 |
| 1025 | H212 | *ZM106.9-chim_d7324.201C-433C | ZM106.9/BG505 chimera | SOSIP, R6, 664, 201C/433C | BG505 Platform, remainder = ZM106.9 | Same as Seq_0379 |
| 1026 | H213 | ZM109.4-chim_d7324.201C-433C | ZM109.4/BG505 chimera | SOSIP, R6, 664, 201C/433C | BG505 Platform, remainder = ZM109.4 | Same as Seq_0379 |
| 1027 | H214 | ZM135.10a-chim_d7324.201C-433C | ZM135.10a/BG505 chimera | SOSIP, R6, 664, 201C/433C | BG505 Platform, remainder = ZM135.10a | Same as Seq_0379 |
| 1028 | H215 | ZM176.66-chim_d7324.201C-433C | ZM176.66/BG505 chimera | SOSIP, R6, 664, 201C/433C | BG505 Platform, remainder = ZM176.66 | Same as Seq_0379 |
| 1029 | H216 | ZM197.7-chim_d7324.201C-433C | ZM197.7/BG505 chimera | SOSIP, R6, 664, 201C/433C | BG505 Platform, remainder = ZM197.7 | Same as Seq_0379 |
| 1030 | H217 | ZM214.15-chim_d7324.201C-433C | ZM214.15/BG505 chimera | SOSIP, R6, 664, 201C/433C | BG505 Platform, remainder = ZM214.15 | Same as Seq_0379 |
| 1031 | H218 | ZM215.8-chim_d7324.201C-433C | ZM215.8/BG505 chimera | SOSIP, R6, 664, 201C/433C | BG505 Platform, remainder = ZM215.8 | Same as Seq_0379 |
| 1032 | H219 | ZM233.6-chim_d7324.201C-433C | ZM233.6/BG505 chimera | SOSIP, R6, 664, 201C/433C | BG505 Platform, remainder = ZM233.6 | Same as Seq_0379 |
| 1033 | H220 | ZM249.1-chim_d7324.201C-433C | ZM249.1/BG505 chimera | SOSIP, R6, 664, 201C/433C | BG505 Platform, remainder = ZM249.1 | Same as Seq_0379 |
| 1034 | H221 | *ZM53.12-chim_d7324.201C-433C | ZM53.12/BG505 chimera | SOSIP, R6, 664, 201C/433C | BG505 Platform, remainder = ZM53.12 | Same as Seq_0379 |
| 1035 | H222 | *ZM55.28a-chim_d7324.201C-433C | ZM55.28a/BG505 chimera | SOSIP, R6, 664, 201C/433C | BG505 Platform, remainder = ZM55.28a | Same as Seq_0379 |
| 1036 | H223 | 6101.1-chim + int_d7324.201C-433C | 6101.1 + int/BG505 chimera | SOSIP, R6, 664, 201C/433C | BG505: Res. 31-45, 478-507, 512-664 and Int. Res. set A; remainder- 6101.1 | Same as Seq_0579 |
| 1037 | H224 | Bal.01-chim + int_d7324.201C-433C | Bal.01 + int/BG505 chimera | SOSIP, R6, 664, 201C/433C | BG505: Res. 31-45, 478-507, 512-664 and Int. Res. set A; remainder- Bal.01 | Same as Seq_0579 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1038 | H225 | BG1168.01-chim + int_d7324.201C-433C | BG1168.01 + int/ BG505 chimera | SOSIP, R6, 664, 201C/433C | BG505: Res. 31-45, 478-507, 512-664 and Int. Res. set A; remainder BG1168.01 | Same as Seq_0579 |
| 1039 | H226 | CAAN.A2-chim + int_d7324.201C-433C | CAAN.A2 + int/ BG505 chimera | SOSIP, R6, 664, 201C/433C | BG505: Res. 31-45, 478-507, 512-664 and Int. Res. set A; remainder CAAN.A2 | Same as Seq_0579 |
| 1040 | H227 | DU156.12-chim + int d7324.201C-433C | DU156.12 + int/ BG505 chimera | SOSIP, R6, 664, 201C/433C | BG505: Res. 31-45, 478-507, 512-664 and Int. Res. set A; remainder DU156.12 | Same as Seq_0579 |
| 1041 | H228 | DU422.01-chim + int d7324.201C-433C | DU422.01 + int/ BG505 chimera | SOSIP, R6, 664, 201C/433C | BG505: Res. 31-45, 478-507, 512-664 and Int. Res. set A; remainder DU422.01 | Same as Seq_0579 |
| 1042 | H229 | JRCSF.JB-chim + int_d7324.201C-433C | JRCSF.JB + int/ BG505 chimera | SOSIP, R6, 664, 201C/433C | BG505: Res. 31-45, 478-507, 512-664 and Int. Res. set A; remainder JRCSF.JB | Same as Seq_0579 |
| 1043 | H230 | JRFL.JB-chim + int_d7324.201C-433C | JRFL.JB + int/ BG505 chimera | SOSIP, R6, 664, 201C/433C | BG505: Res. 31-45, 478-507, 512-664 and Int. Res. set A; remainder JRFL.JB | Same as Seq_0579 |
| 1044 | H231 | KER2018.11-chim + int_d7324.201C-433C | KER2018.11 + int/BG505 chimera | SOSIP, R6, 664, 201C/433C | BG505: Res. 31-45, 478-507, 512-664 and Int. Res. set A; remainder KER2018.11 | Same as Seq_0579 |
| 1045 | H232 | PVO.04-chim + int_d7324.201C-433C | PVO.04 + int/ BG505 chimera | SOSIP, R6, 664, 201C/433C | BG505: Res. 31-45, 478-507, 512-664 and Int. Res. set A; remainder PVO.04 | Same as Seq_0579 |
| 1046 | H233 | Q168.a2-chim + int_d7324.201C-433C | Q168.a2 + int/ BG505 chimera | SOSIP, R6, 664, 201C/433C | BG505: Res. 31-45, 478-507, 512-664 and Int. Res. set A; remainder Q168.a2 | Same as Seq_0579 |
| 1047 | H234 | Q23.17-chim + int_d7324.201C-433C | Q23.17 + int/ BG505 chimera | SOSIP, R6, 664, 201C/433C | BG505: Res. 31-45, 478-507, 512-664 and Int. Res. set A; remainder Q23.17 | Same as Seq_0579 |

| 1 SEQ ID NO | 2 Code | 3 Name | 4 Native Background | 5 Mutations Compared to Native Background | 6 Additional mutations | 7 Comment |
|---|---|---|---|---|---|---|
| 1048 | H235 | Q769.h5-chim + int_d7324.201C-433C | Q769.h5 + int/ BG505 chimera | SOSIP, R6, 664, 201C/433C | BG505: Res. 31-45, 478-507, 512-664 and Int. Res. set A; remainder-Q769.h5 | Same as Seq_0579 |
| 1049 | H236 | RW020.2-chim + int_d7324.201C-433C | RW020.2 + int/ BG505 chimera | SOSIP, R6, 664, 201C/433C | BG505: Res. 31-45, 478-507, 512-664 and Int. Res. set A; remainder-RW020.2 | Same as Seq_0579 |
| 1050 | H237 | THRO.18-chim + int_d7324.201C-433C | THRO.18 + int/ BG505 chimera | SOSIP, R6, 664, 201C/433C | BG505: Res. 31-45, 478-507, 512-664 and Int. Res. set A; remainder-THRO.18 | Same as Seq_0579 |
| 1051 | H238 | TRJO.58-chim + int_d7324.201C-433C | TRJO.58 + int/ BG505 chimera | SOSIP, R6, 664, 201C/433C | BG505: Res. 31-45, 478-507, 512-664 and Int. Res. set A; remainder-TRJO.58 | Same as Seq_0579 |
| 1052 | H239 | TRO.11-chim + int_d7324.201C-433C | TRO.11 + int/ BG505 chimera | SOSIP, R6, 664, 201C/433C | BG505: Res. 31-45, 478-507, 512-664 and Int. Res. set A; remainder-TRO.11 | Same as Seq_0579 |
| 1053 | H240 | YU2.DG-chim + int_d7324.201C-433C | YU2.DG + int/ BG505 chimera | SOSIP, R6, 664, 201C/433C | BG505: Res. 31-45, 478-507, 512-664 and Int. Res. set A; remainder-YU2.DG | Same as Seq_0579 |
| 1054 | H241 | ZA012.29-chim + int_d7324.201C-433C | ZA012.29 + int/ BG505 chimera | SOSIP, R6, 664, 201C/433C | BG505: Res. 31-45, 478-507, 512-664 and Int. Res. set A; remainder-ZA012.29 | Same as Seq_0579 |
| 1055 | H242 | ZM106.9-chim + int_d7324.201C-433C | ZM106.9 + int/ BG505 chimera | SOSIP, R6, 664, 201C/433C | BG505: Res. 31-45, 478-507, 512-664 and Int. Res. set A; remainder-ZM106.9 | Same as Seq_0579 |
| 1056 | H243 | ZM55.28a-chim + int_d7324.201C-433C | ZM55.28a + int/ BG505 chimera | SOSIP, R6, 664, 201C/433C | BG505: Res. 31-45, 478-507, 512-664 and Int. Res. set A; remainder-ZM55.28a | Same as Seq_0579 |
| 1057 | A326 | *6101.1.sosip_d7324.201C-433C | 6101.1 | SOSIP, R6, 664, 201C/433C | 201C, 433C | |
| 1058 | A327 | *Bal.01.sosip_d7324.201C-433C | Bal.01 | SOSIP, R6, 664, 201C/433C | 201C, 433C | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1059 | A328 | *BG1168.01.sosip_d7324.201C-433C | BG1168.01 | SOSIP, R6, 664, | 201C, 433C | |
| 1060 | A329 | *CAAN.A2.sosip_d7324.201C-433C | CAAN.A2 | SOSIP, R6, 664, | 201C, 433C | |
| 1061 | A330 | *DU156.12.sosip_d7324.201C-433C | DU156.12 | SOSIP, R6, 664, | 201C, 433C | |
| 1062 | A331 | *DU422.01.sosip_d7324.201C-433C | DU422.01 | SOSIP, R6, 664, | 201C, 433C | |
| 1063 | A332 | *JRC5F.JB.sosip_d7324.201C-433C | JRCSF.JB | SOSIP, R6, 664, | 201C, 433C | |
| 1064 | A333 | *JRFLIB.sosip_d7324.201C-433C | JRFL.JB | SOSIP, R6, 664, | 201C, 433C | |
| 1065 | A334 | *KER2018.11.sosip_d7324.201C-433C | KER2018.11 | SOSIP, R6, 664, | 201C, 433C | |
| 1066 | A335 | *PVO.04.sosip_d7324.201C-433C | PVO.04 | SOSIP, R6, 664, | 201C, 433C5 | |
| 1067 | A336 | *Q168.a2.sosip_d7324.201C-433C | Q168.a2 | SOSIP, R6, 664, | 201C, 433C | |
| 1068 | A337 | *Q23.17.sosip_d7324.201C-433C | Q23.17 | SOSIP, R6, 664, | 201C, 433C | |
| 1069 | A338 | *Q769.h5.sosip_d7324.201C-433C | Q769.h5 | SOSIP, R6, 664, | 201C, 433C5 | |
| 1070 | A339 | *RW020.2.sosip_d7324.201C-433C | RW020.2 | SOSIP, R6, 664, | 201C, 433C | |
| 1071 | A340 | *THRO.18.sosip_d7324.201C-433C | THRO.18 | SOSIP, R6, 664, | 201C, 433C | |
| 1072 | A341 | *TRJO.58.sosip_d7324.201C-433C | TRJO.58 | SOSIP, R6, 664, | 201C, 433C | |
| 1073 | A342 | *TRO.11.sosip_d7324.201C-433C | TRO.11 | SOSIP, R6, 664, | 201C, 433C | |
| 1074 | A343 | *YU2.DG.sosip_d7324.201C-433C | YU2.DG | SOSIP, R6, 664, | 201C, 433C | |
| 1075 | A344 | *ZA012.29.sosip_d7324.201C-433C | ZA012.29 | SOSIP, R6, 664, | 201C, 433C | |
| 1076 | A345 | *ZM106.9.sosip_d7324.201C-433C | ZM106.9 | SOSIP, R6, 664, | 201C, 433C | |
| 1077 | A346 | *ZM55.28a.sosip_d7324.201C-433C | ZM55.28a | SOSIP, R6, 664, | 201C, 433C | |
| 1078 | H244 | 6101.1-chim-sc_d7324.201C-433C | 6101.1/BG505 chimera | SOSIP, R6, 664, 201C/433C | Seq_0534 linker between 508-511, BG505 Platform, remainder = ZM55.28a | Chimeric single chain Env with BG505gp41ecto/gp120-NC "platform" and heterologous gp120 |
| 1079 | H245 | Bal.01-chim-sc_d7324.201C-433C | Bal.01/BG505 chimera | SOSIP, R6, 664, 201C/433C | Seq_0534 linker between 508-511, BG505 Platform, remainder = Bal.01 | Same as Seq_1078 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1080 | H246 | BG1168.01-chim-sc_d7324.201C-433C | BG1168.01/BG505 chimera | SOSIP, R6, 664, 201C/433C | Seq_0534 linker between 508-511, BG505 Platform, remainder = BG1168.01 | Same as Seq_1078 |
| 1081 | H247 | CAAN.A2-chim-sc_d7324.201C-433C | CAAN.A2/BG505 chimera | SOSIP, R6, 664, 201C/433C | Seq_0534 linker between 508-511, Res. 31-45, 478-507, 512-664 from BG505, remainder = CAAN.A2 | Same as Seq_1078 |
| 1082 | H248 | DU156.12-chim-sc_d7324.201C-433C | DU156.12/BG505 chimera | SOSIP, R6, 664, 201C/433C | Seq_0534 linker between 508-511, BG505 Platform, remainder = DU156.12 | Same as Seq_1078 |
| 1083 | H249 | DU422.01-chim-sc_d7324.201C-433C | DU422.01/BG505 chimera | SOSIP, R6, 664, 201C/433C | Seq_0534 linker between 508-511, BG505 Platform, remainder = DU422.01 | Same as Seq_1078 |
| 1084 | H250 | JRCSF.JB-chim-sc_d7324.201C-433C | JRCSF.JB/BG505 chimera | SOSIP, R6, 664, 201C/433C | Seq_0534 linker between 508-511, BG505 Platform, remainder = JRCSF.JB | Same as Seq_1078 |
| 1085 | H251 | JRFL.JB-chim-sc_d7324.201C-433C | JRFL.JB/BG505 chimera | SOSIP, R6, 664, 201C/433C | Seq_0534 linker between 508-511, Res. 31-45, 478-507, 512-664 from BG505, remainder = JRFL.JB | Same as Seq_1078 |
| 1086 | H252 | KER2018.11-chim-sc_d7324.201C-433C | KER2018.11/BG505 chimera | SOSIP, R6, 664, 201C/433C | Seq_0534 linker between 508-511, BG505 Platform, remainder = KER2018.11 | Same as Seq_1078 |
| 1087 | H253 | PVO.04-chim-sc_d7324.201C-433C | PVO.04/BG505 chimera | SOSIP, R6, 664, 201C/433C | Seq_0534 linker between 508-511, BG505 Platform, remainder = PVO.04 | Same as Seq_1078 |
| 1088 | H254 | Q168.a2-chim-sc_d7324.201C-433C | Q168.a2/BG505 chimera | SOSIP, R6, 664, 201C/433C | Seq_0534 linker between 508-511, BG505 Platform, remainder = Q168.a2 | Same as Seq_1078 |
| 1089 | H255 | Q23.17-chim-sc_d7324.201C-433C | Q23.17/BG505 chimera | SOSIP, R6, 664, 201C/433C | Seq_0534 linker between 508-511, BG505 Platform, remainder = Q23.17 | Same as Seq_1078 |
| 1090 | H256 | Q769.h5-chim-sc_d7324.201C-433C | Q769.h5/BG505 chimera | SOSIP, R6, 664, 201C/433C | Seq_0534 linker between 508-511, BG505 Platform, remainder = Q769.h5 | Same as Seq_1078 |

| SEQ ID NO | Code | Name | Native Background | Mutations Compared to Native Background | Additional mutations | Comment |
|---|---|---|---|---|---|---|
| 1091 | H257 | RW020.2-chim-sc_d7324.201C-433C | RW020.2/BG505 chimera | SOSIP, R6, 664, 201C/433C | Seq_0534 linker between 508-511, BG505 Platform, remainder = RW020.2 | Same as Seq_1078 |
| 1092 | H258 | THRO.18-chim-sc_d7324.201C-433C | THRO.18/BG505 chimera | SOSIP, R6, 664, 201C/433C | Seq_0534 linker between 508-511, BG505 Platform, remainder = THRO.18 | Same as Seq_1078 |
| 1093 | H259 | TRJO.58-chim-sc_d7324.201C-433C | TRJO.58/BG505 chimera | SOSIP, R6, 664, 201C/433C | Seq_0534 linker between 508-511, BG505 Platform, remainder = TRJO.58 | Same as Seq_1078 |
| 1094 | H260 | TRO.11-chim-sc_d7324.201C-433C | TRO.11/BG505 chimera | SOSIP, R6, 664, 201C/433C | Seq_0534 linker between 508-511, BG505 Platform, remainder = TRO.11 | Same as Seq_1078 |
| 1095 | H261 | YU2.DG-chim-sc_d7324.201C-433C | YU2.DG/BG505 chimera | SOSIP, R6, 664, 201C/433C | Seq_0534 linker between 508-511, BG505 Platform, remainder = YU2.DG | Same as Seq_1078 |
| 1096 | H262 | ZA012.29-chim-sc_d7324.201C-433C | ZA012.29/BG505 chimera | SOSIP, R6, 664, 201C/433C | Seq_0534 linker between 508-511, BG505 Platform, remainder = ZA012.29 | Same as Seq_1078 |
| 1097 | H263 | ZM106.9-chim-sc_d7324.201C-433C | ZM106.9/BG505 chimera | SOSIP, R6, 664, 201C/433C | Seq_0534 linker between 508-511, BG505 Platform, remainder = ZM106.9 | Same as Seq_1078 |
| 1098 | H264 | ZM55.28a-chim-sc_d7324.201C-433C | ZM55.28a/BG505 chimera | SOSIP, R6, 664, 201C/433C | Seq_0534 linker between 508-511, BG505 Platform, remainder = ZM55.28a | Same as Seq_1078 |
| 1099 | H265 | ZM53_bg505-NCgp120 + gp41.SOSIP_ds201-433_3bve-5ln | ZM53/BG505 chimera | SOSIP, R6, 664, 201C/433C; 332N | BG505 Platform, remainder = ZM53, ferritin linked to gp41-C | Ferritin particle with Chimeric gp140 with BG505 gp4lecto/gp120-NC "platform" and heterologous gp120 |
| 1100 | H266 | CNE55-glyc332_bg505-NCgp120 + gp41.SOSIP_ds201-433_ferr-5ln | CNE55/BG505 chimera | SOSIP, R6, 664, 201C/433C | BG505 Platform, remainder = CNE55, ferritin linked to gp41-C | Same as Seq_1099 |
| 1101 | H267 | P0402_C11_bg505-NCgp120 + gp41.SOSIP_ds201-433_ferr-5ln | P0402_C11/BG505 chimera | SOSIP, R6, 664, 201C/433C | BG505 Platform, remainder = P0402_C11, ferritin linked to gp41-C | Same as Seq_1099 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1102 | H268 | X1193_C1_bg505-NCgp120 + gp41.SOSIP_ds201-433_ferr-5ln | X1193_C1/BG505 chimera | SOSIP, R6, 664, 201C/433C | BG505 Platform, remainder = X1193_C1, ferritin linked to gp41-C | Same as Seq_1099 |
| 1103 | H269 | DU156.12_bg505-NCgp120 + gp41.SOSIP_ds201-433_ferr-5ln | DU156.12/BG505 chimera | SOSIP, R6, 664, 201C/433C | BG505 Platform, remainder = DU156.12, ferritin linked to gp41-C | Same as Seq_1099 |
| 1104 | H270 | DU422.01_bg505-NCgp120 + gp41.SOSIP_ds201-433_ferr-5ln | DU422.01/BG505 chimera | SOSIP, R6, 664, 201C/433C | BG505 Platform, remainder = DU422.01, ferritin linked to gp41-C | Same as Seq_1099 |
| 1105 | H271 | 25925-2.22_bg505-NCgp120 + gp41.SOSIP_ds201-433_3bve-5ln | 25925-2.22/BG505 chimera | SOSIP, R6, 664, 201C/433C | BG505 Platform, remainder = 25925-2.22, ferritin linked to gp41-C | Same as Seq_1099 |
| 1106 | H272 | 3301_V1_C24_bg505-NCgp120 + gp41.SOSIP_ds201-433_3bve-5ln | 3301_V1_C24/BG505 chimera | SOSIP, R6, 664, 201C/433C | BG505 Platform, remainder= 3301_V1_C24, ferritin linked to gp41-C | Same as Seq_1099 |
| 1107 | H273 | Cap256-SU_bg505-NCgp120 + gp41.SOSIP_ds201-433_3bve-5ln | Cap256-SU/BG505 chimera | SOSIP, R6, 664, 201C/433C | BG505 Platform, remainder = Cap256-SU, ferritin linked to gp41-C | Same as Seq_1099 |
| 1108 | H274 | CH117.4_332N_bg505-NCgp120 + gp41.SOSIP_ds201-433_3bve-5ln | CH117.4_332N/ BG505 chimera | SOSIP, R6, 664, 201C/433C | BG505 Platform, remainder = CH117.4_332N, ferritin linked to gp41-C | Same as Seq_1099 |
| 1109 | H275 | CNE58_SU-strandC_bg505-NCgp120 + gp41.SOSIP_ds201-433_3bve-5ln | CNE58_SU-strandC/ BG505 chimera | SOSIP, R6, 664, 201C/433C | BG505 Platform , Res. 166-173 (strand C) from CAP256-SU, remainder = CNE58, ferritin linked to gp41-C | Same as Seq_1099 |
| 1110 | H276 | KER2018.11_bg505-NCgp120 + gp41.SOSIP_ds201-433_3bve-5ln | KER2018.11/ BG505 chimera | SOSIP, R6, 664, 201C/433C | BG505 Platform, remainder = KER2018.11, ferritin linked to gp41-C | Same as Seq_1099 |

| SEQ ID NO | Code | Name | Native Background | Mutations Compared to Native Background | Additional mutations | Comment |
|---|---|---|---|---|---|---|
| 1111 | H277 | ZM233.6_bg505-NCgp120 + int + gp41.SOSIP_ds201-433_3bve-5ln | ZM233.6/BG505 chimera | SOSIP, R6, 664, 201C/433C | BG505 Platform, remainder = ZM233.6 ferritin linked to gp41-C | Same as Seq_1099 |
| 1112 | H278 | ZM53_bg505-NCgp120 + gp41.SOSIP_ds201-433_3bve-5ln | ZM53/BG505 chimera | SOSIP, R6, 664, 201C/433C | BG505 Platform, remainder = ZM53, ferritin linked to gp41-C | Same as Seq_1099 |
| 1113 | H279 | 45_01dG5_bg505-NCgp120 + gp41.SOSIP_ds201-433_3bve-5ln | G5 from d45/ BG505 chimera | SOSIP, R6, 664, 201C/433C | BG505 Platform, remainder = dG5, ferritin linked to gp41-C | Same as Seq_1099 |
| 1114 | H280 | 231965.c1-chim_d7324.201C-433C.mi-cl-min | 231965.c1/BG505 chimera | SOSIP, R6, 664, 201C/433C | BG505 Platform, Res. Set B (Res. 133; 134; 164; 169; 308; 316) from BG505 ("BG505 Res. Set B"), remainder = 231965.c1 | Chimeric gp140 with gp41ecto/gp120-NC "platform" and BG505 Res. Set B, and heterologous gp120 |
| 1115 | H281 | 288.38-chim_d7324.201C-433C.mi-cl-min | 288.38/BG505 chimera | SOSIP, R6, 664, 201C/433C | BG505 Platform, BG505 Res. Set B, remainder = 288.38 | Same as Seq_1114 |
| 1116 | H282 | 3415.v1.c1-chim_d7324.201C-433C.mi-cl-min | 3415.v1.c1/BG505 chimera | SOSIP, R6, 664, 201C/433C | BG505 Platform, BG505 Res. Set B, remainder = 3415.v1.c1 | Same as Seq_1114 |
| 1117 | H283 | 3817.v2.c59-chim_d7324.201C-433C.mi-cl-min | 3817.v2.c59/ BG505 chimera | SOSIP, R6, 664, 201C/433C | BG505 Platform, BG505 Res. Set B, remainder = 3817.v2.c59 | Same as Seq_1114 |
| 1118 | H284 | 57128.vrc15-chim_d7324.201C-433C.mi-cl-min | 57128.vrc15/ BG505 chimera | SOSIP, R6, 664, 201C/433C | BG505 Platform, BG505 Res. Set B, remainder = 57128.vrc15 | Same as Seq_1114 |
| 1119 | H285 | 6535.3-chim_d7324.201C-433C.mi-cl-min | 6535.3/BG505 chimera | SOSIP, R6, 664, 201C/433C | BG505 Platform, BG505 Res. Set B, remainder = 6535.3 | Same as Seq_1114 |
| 1120 | H286 | 89.6.DG-chim_d7324.201C-433C.mi-cl-min | 89.6.DG/BG505 chimera | SOSIP, R6, 664, 201C/433C | BG505 Platform, BG505 Res. Set B, remainder = 89.6.DG | Same as Seq_1114 |
| 1121 | H287 | A03349M1.vrc4a-chim_d7324.201C-433C.mi-cl-min | A03349M1.vrc4a/ BG505 chimera | SOSIP, R6, 664, 201C/433C | BG505 Platform, BG505 Res. Set B, remainder = A03349M1.vrc4a | Same as Seq_1114 |

-continued

| SEQ ID NO | Code | Name | Native Background | Mutations Compared to Native Background | Additional mutations | Comment |
|---|---|---|---|---|---|---|
| 1122 | H288 | Bal.01-chim_d7324.201C-433C.mi-cl-min | Bal.01/BG505 chimera | SOSIP, R6, 664, 201C/433C | BG505 Platform, BG505 Res. Set B, remainder = Bal.01 | Same as Seq_1114 |
| 1123 | H289 | BaL.26-chim_d7324.201C-433C.mi-cl-min | BaL.26/BG505 chimera | SOSIP, R6, 664, 201C/433C | BG505 Platform, BG505 Res. Set B, remainder = BaL.26 | Same as Seq_1114 |
| 1124 | H290 | BG1168.01-chim_d7324.201C-433C.mi-cl-min | BG1168.01/BG505 chimera | SOSIP, R6, 664, 201C/433C | BG505 Platform, BG505 Res. Set B, remainder = BG1168.01 | Same as Seq_1114 |
| 1125 | H291 | BR07.DG-chim_d7324.201C-433C.mi-cl-min | BR07.DG/BG505 chimera | SOSIP, R6, 664, 201C/433C | BG505 Platform, BG505 Res. Set B, remainder = BR07.DG | Same as Seq_1114 |
| 1126 | H292 | CNE10-chim_d7324.201C-433C.mi-cl-min | CNE10/BG505 chimera | SOSIP, R6, 664, 201C/433C | BG505 Platform, BG505 Res. Set B, remainder = CNE10 | Same as Seq_1114 |
| 1127 | H293 | CNE30-chim_d7324.201C-433C.mi-cl-min | CNE30/BG505 chimera | SOSIP, R6, 664, 201C/433C | BG505 Platform, BG505 Res. Set B, remainder = CNE30 | Same as Seq_1114 |
| 1128 | H294 | CNE4-chim_d7324.201C-433C.mi-cl-min | CNE4/BG505 chimera | SOSIP, R6, 664, 201C/433C | BG505 Platform, BG505 Res. Set B, remainder = CNE4 | Same as Seq_1114 |
| 1129 | H295 | JRCSF.JB-chim_d7324.201C-433C.mi-cl-min | JRCSF.JB/BG505 chimera | SOSIP, R6, 664, 201C/433C | BG505 Platform, BG505 Res. Set B, remainder = JRCSF.JB | Same as Seq_1114 |
| 1130 | H296 | JRFLIB-chim_d7324.201C-433C.mi-cl-min | JRFLIB/BG505 chimera | SOSIP, R6, 664, 201C/433C | BG505 Platform, BG505 Res. Set B, remainder = JRFL.JB | Same as Seq_1114 |
| 1131 | H297 | MB539.2137-chim_d7324.201C-433C.mi-cl-min | MB539.2137/BG505 chimera | SOSIP, R6, 664, 201C/433C | BG505 Platform, BG505 Res. Set B, remainder = MB539.267 | Same as Seq_1114 |
| 1132 | H298 | MN.3-chim_d7324.201C-433C.mi-cl-min | MN.3/BG505 chimera | SOSIP, R6, 664, 201C/433C | BG505 Platform, BG505 Res. Set B, remainder = MN.3 | Same as Seq_1114 |
| 1133 | H299 | NKU3006.ec1-chim_d7324.201C-433C.mi-cl-min | NKU3006.ec1/BG505 chimera | SOSIP, R6, 664, 201C/433C | BG505 Platform, BG505 Res. Set B, remainder = NKU3006.ec1 | Same as Seq_1114 |

-continued

| 1<br>SEQ<br>ID NO | 2<br>Code | 3<br>Name | 4<br>Native<br>Background | 5<br>Mutations Compared to<br>Native Background | 6<br>Additional mutations | 7<br>Comment |
|---|---|---|---|---|---|---|
| 1134 | H300 | PVO.04-chim_d7324.201C-433C.mi-cl-min | PVO.04/BG505 chimera | SOSIP, R6, 664, 201C/433C | BG505 Platform, BG505 Res. Set B, remainder = PVO.04 | Same as Seq_1114 |
| 1135 | H301 | Q259.17-chim_d7324.201C-433C.mi-cl-min | Q259.17/BG505 chimera | SOSIP, R6, 664, 201C/433C | BG505 Platform, BG505 Res. Set B, remainder = Q259.17 | Same as Seq_1114 |
| 1136 | H302 | QH0692.42-chim_d7324.201C-433C.mi-cl-min | QH0692.42/BG505 chimera | SOSIP, R6, 664, 201C/433C | BG505 Platform, BG505 Res. Set B, remainder = QH0692.42 | Same as Seq_1114 |
| 1137 | H303 | SF162.LS-chim_d7324.201C-433C.mi-cl-min | SF162.LS/BG505 chimera | SOSIP, R6, 664, 201C/433C | BG505 Platform, BG505 Res. Set B, remainder = SF162.LS | Same as Seq_1114 |
| 1138 | H304 | 551196.01-chim_d7324.201C-433C.mi-cl-min | 551196.01/BG505 chimera | SOSIP, R6, 664, 201C/433C | BG505 Platform, BG505 Res. Set B, remainder = SS1196.01 | Same as Seq_1114 |
| 1139 | H305 | T266-60-chim_d7324.201C-433C.mi-cl-min | T266-60/BG505 chimera | SOSIP, R6, 664, 201C/433C | BG505 Platform, BG505 Res. Set B, remainder = T266-60 | Same as Seq_1114 |
| 1140 | H306 | T280-5-chim_d7324.201C-433C.mi-cl-min | T280-5/BG505 chimera | SOSIP, R6, 664, 201C/433C | BG505 Platform, BG505 Res. Set B, remainder = T280-5 | Same as Seq_1114 |
| 1141 | H307 | UG024.2-chim_d7324.201C-433C.mi-cl-min | UG024.2/BG505 chimera | SOSIP, R6, 664, 201C/433C | BG505 Platform, BG505 Res. Set B, remainder = UG024.2 | Same as Seq_1114 |
| 1142 | H308 | ZM215.8-chim_d7324.201C-433C.mi-cl-min | ZM215.8/BG505 chimera | SOSIP, R6, 664, 201C/433C | BG505 Platform, BG505 Res. Set B, remainder = ZM215.8 | Same as Seq_1114 |
| 1143 | H309 | 231965.c1-chim_d7324.201C-433C.mi-cl1 | 231965.c1/BG505 chimera | SOSIP, R6, 664, 201C/433C | BG505 Platform, Res. Set C (Res. 49; 133; 134; 149; 150; 151; 152; 164; 169; 188; 190; 211; 223; 252; 281; 293; 308; 316; 336; 340; 352; 360; 362; 363; 369; 372; 393; 410; 432; 442; 444; 446; 474; 476) from BG505 ("BG505 Res. Set C"), remainder = ZM215.8 | Chimeric gp140 with gp41ecto/gp120-NC "platform" and Res. Set C from BG505, and heterologous gp120 |

| SEQ ID NO | Code | Name | Native Background | Mutations Compared to Native Background | Additional mutations | Comment |
|---|---|---|---|---|---|---|
| 1144 | H310 | 288.38-chim_d7324.201C-433C.mi-cl1 | 288.38/BG505 chimera | SOSIP, R6, 664, 201C/433C | BG505 Platform, Res. Set C from BG505, remainder = 288.38 | Same as Seq_1143 |
| 1145 | H311 | 3415.v1.c1-chim_d7324.201C-433C.mi-cl1 | 3415.v1.c1/BG505 chimera | SOSIP, R6, 664, 201C/433C | BG505 Platform, BG505 Res. Set C, remainder = 3415.v1.c1 | Same as Seq_1143 |
| 1146 | H312 | 3817.v2.c59-chim_d7324.201C-433C.mi-cl1 | 3817.v2.c59/BG505 chimera | SOSIP, R6, 664, 201C/433C | BG505 Platform, BG505 Res. Set C, remainder = 3817.v2.c59 | Same as Seq_1143 |
| 1147 | H313 | 57128.vrc15-chim_d7324.201C-433C.mi-cl1 | 57128.vrc15/BG505 chimera | SOSIP, R6, 664, 201C/433C | BG505 Platform, BG505 Res. Set C, remainder = 57128.vrc15 | Same as Seq_1143 |
| 1148 | H314 | 6535.3-chim_d7324.201C-433C.mi-cl1 | 6535.3/BG505 chimera | SOSIP, R6, 664, 201C/433C | BG505 Platform, BG505 Res. Set C, remainder = 6535.3 | Same as Seq_1143 |
| 1149 | H315 | 89.6.DG-chim_d7324.201C-433C.mi-cl1 | 89.6.DG/BG505 chimera | SOSIP, R6, 664, 201C/433C | BG505 Platform, BG505 Res. Set C, remainder = 89.6.DG | Same as Seq_1143 |
| 1150 | H316 | A03349M1.vrc4a-chim_d7324.201C-433C.mi-cl1 | A03349M1.vrc4a/BG505 chimera | SOSIP, R6, 664, 201C/433C | BG505 Platform, BG505 Res. Set C, remainder = A03349M1.vrc4a | Same as Seq_1143 |
| 1151 | H317 | Bal.01-chim_d7324.201C-433C.mi-cl1 | Bal.01/BG505 chimera | SOSIP, R6, 664, 201C/433C | BG505 Platform, BG505 Res. Set C, remainder = Bal.01 | Same as Seq_1143 |
| 1152 | H318 | BaL.26-chim_d7324.201C-433C.mi-cl1 | BaL.26/BG505 chimera | SOSIP, R6, 664, 201C/433C | BG505 Platform, BG505 Res. Set C, remainder = BaL.26 | Same as Seq_1143 |
| 1153 | H319 | BG1168.01-chim_d7324.201C-433C.mi-cl1 | BG1168.01/BG505 chimera | SOSIP, R6, 664, 201C/433C | BG505 Platform, BG505 Res. Set C, remainder = BG1168.01 | Same as Seq_1143 |
| 1154 | H320 | BR07.DG-chim_d7324.201C-433C.mi-cl1 | BR07.DG/BG505 chimera | SOSIP, R6, 664, 201C/433C | BG505 Platform, BG505 Res. Set C, remainder = BR07.DG | Same as Seq_1143 |
| 1155 | H321 | CNE10-chim_d7324.201C-433C.mi-cl1 | CNE10/BG505 chimera | SOSIP, R6, 664, 201C/433C | BG505 Platform, BG505 Res. Set C, remainder = CNE10 | Same as Seq_1143 |

| 1 SEQ ID NO | 2 Code | 3 Name | 4 Native Background | 5 Mutations Compared to Native Background | 6 Additional mutations | 7 Comment |
|---|---|---|---|---|---|---|
| 1156 | H322 | CNE30-chim_d7324.201C-433C.mi-cl1 | CNE30/BG505 chimera | SOSIP, R6, 664, 201C/433C | BG505 Platform, BG505 Res. Set C, remainder = CNE30 | Same as Seq_1143 |
| 1157 | H323 | CNE4-chim_d7324.201C-433C.mi-cl1 | CNE4/BG505 chimera | SOSIP, R6, 664, 201C/433C | BG505 Platform, BG505 Res. Set C, remainder = CNE4 | Same as Seq_1143 |
| 1158 | H324 | JRCSF.JB-chim_d7324.201C-433C.mi-cl1 | JRCSF.JB/BG505 chimera | SOSIP, R6, 664, 201C/433C | BG505 Platform, BG505 Res. Set C, remainder = JRCSF.JB | Same as Seq_1143 |
| 1159 | H325 | JRFL.JB-chim_d7324.201C-433C.mi-cl1 | JRFL.JB/BG505 chimera | SOSIP, R6, 664, 201C/433C | BG505 Platform, BG505 Res. Set C, remainder = JRFL.JB | Same as Seq_1143 |
| 1160 | H326 | MB539.2137-chim_d7324.201C-433C.mi-cl1 | MB539.2137/BG505 chimera | SOSIP, R6, 664, 201C/433C | BG505 Platform, BG505 Res. Set C, remainder = MB539.267 | Same as Seq_1143 |
| 1161 | H327 | MN.3-chim_d7324.201C-433C.mi-cl1 | MN.3/BG505 chimera | SOSIP, R6, 664, 201C/433C | BG505 Platform, BG505 Res. Set C, remainder = MN.3 | Same as Seq_1143 |
| 1162 | H328 | NKU3006.ec1-chim_d7324.201C-433C.mi-cl1 | NKU3006.ec1/BG505 chimera | SOSIP, R6, 664, 201C/433C | BG505 Platform, BG505 Res. Set C, remainder = NKU3006.ec1 | Same as Seq_1143 |
| 1163 | H329 | PVO.04-chim_d7324.201C-433C.mi-cl1 | PVO.04/BG505 chimera | SOSIP, R6, 664, 201C/433C | BG505 Platform, BG505 Res. Set C, remainder = PVO.04 | Same as Seq_1143 |
| 1164 | H330 | Q259.17-chim_d7324.201C-433C.mi-cl1 | Q259.17/BG505 chimera | SOSIP, R6, 664, 201C/433C | BG505 Platform, BG505 Res. Set C, remainder = Q259.17 | Same as Seq_1143 |
| 1165 | H331 | QH0692.42-chim_d7324.201C-433C.mi-cl1 | QH0692.42/BG505 chimera | SOSIP, R6, 664, 201C/433C | BG505 Platform, BG505 Res. Set C, remainder = QH0692.42 | Same as Seq_1143 |
| 1166 | H332 | SF162.LS-chim_d7324.201C-433C.mi-cl1 | SF162.LS/BG505 chimera | SOSIP, R6, 664, 201C/433C | BG505 Platform, BG505 Res. Set C, remainder = SF162.LS | Same as Seq_1143 |
| 1167 | H333 | SS1196.01-chim_d7324.201C-433C.mi-cl1 | SS1196.01/BG505 chimera | SOSIP, R6, 664, 201C/433C | BG505 Platform, BG505 Res. Set C, remainder = SS1196.01 | Same as Seq_1143 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1168 | H334 | T266-60-chim_d7324.201C-433C.mi-cl1 | T266-60/BG505 chimera | SOSIP, R6, 664, 201C/433C | BG505 Platform, BG505 Res. Set C, remainder = T266-60 | Same as Seq_1143 |
| 1169 | H335 | T280-5-chim_d7324.201C-433C.mi-cl1 | T280-5/BG505 chimera | SOSIP, R6, 664, 201C/433C | BG505 Platform, BG505 Res. Set C, remainder = T280-5 | Same as Seq_1143 |
| 1170 | H336 | UG024.2-chim_d7324.201C-433C.mi-cl1 | UG024.2/BG505 chimera | SOSIP, R6, 664, 201C/433C | BG505 Platform, BG505 Res. Set C, remainder = UG024.2 | Same as Seq_1143 |
| 1171 | H337 | ZM215.8-chim_d7324.201C-433C.mi-cl1 | ZM215.8/BG505 chimera | SOSIP, R6, 664, 201C/433C | BG505 Platform, BG505 Res. Set C, remainder = ZM215.8 | Same as Seq_1143 |
| 1172 | H338 | 231965.c1-chim_d7324.201C-433C.mi-cl1-2 | 231965.c1/BG505 chimera | SOSIP, R6, 664, 201C/433C | BG505 Platform, Res. Set C, + Res. Set D (46; 60; 62; 63; 84; 85; 87; 99; 102; 130; 132; 135; 153; 158; 160; 161; 165; 166; 167; 171; 172; 173; 175; 177; 178; 181; 184; 185; 189; 202; 232; 234; 236; 240; 268; 269; 270; 271; 275; 277; 287; 289; 292; 295; 297; 305; 315; 317; 319; 322; 328; 330; 332; 333; 334; 335; 337; 339; 343; 344; 345; 346; 347; 350; 351; 357; 371; 375; 379; 387; 389; 394; 411; 412; 413; 415; 424; 426; 429; 440; 460; 461; 465; 475; 477) from BG505 ("BG505 Res. Set D"), remainder = 231965.c1 | Chimeric gp140 with gp41ecto/gp120-NC "platform" and Res. Sets C and D from BG505, and heterologous gp120 |
| 1173 | H339 | 288.38-chim_d7324.201C-433C.mi-cl1-2 | 288.38/BG505 chimera | SOSIP, R6, 664, 201C/433C | BG505 Platform, BG505 Res. Sets C +D, remainder = 288.38 | Same as Seq_1172 |
| 1174 | H340 | 3415.v1.cl-chim_d7324.201C-433C.mi-cl1-2 | 3415.v1.cl/BG505 chimera | SOSIP, R6, 664, 201C/433C | BG505 Platform, BG505 Res. Sets C + D, remainder = 3415.v1.cl | Same as Seq_1172 |

| 1 SEQ ID NO | 2 Code | 3 Name | 4 Native Background | 5 Mutations Compared to Native Background | 6 Additional mutations | 7 Comment |
|---|---|---|---|---|---|---|
| 1175 | H341 | 3817.v2.c59-chim_d7324.201C-433C.mi-cl1-2 | 3817.v2.c59/BG505 chimera | SOSIP, R6, 664, 201C/433C | BG505 Platform, BG505 Res. Sets C + D, remainder = 3817.v2.c59 | Same as Seq_1172 |
| 1176 | H342 | 57128.vrc15-chim_d7324.201C-433C.mi-cl1-2 | 57128.vrc15/BG505 chimera | SOSIP, R6, 664, 201C/433C | BG505 Platform, BG505 Res. Sets C + D, remainder = 57128.vrc15 | Same as Seq_1172 |
| 1177 | H343 | 6535.3-chim_d7324.201C-433C.mi-cl1-2 | 6535.3/BG505 chimera | SOSIP, R6, 664, 201C/433C | BG505 Platform, BG505 Res. Sets C + D, remainder = 6535.3 | Same as Seq_1172 |
| 1178 | H344 | 89.6.DG-chim_d7324.201C-433C.mi-cl1-2 | 89.6.DG/BG505 chimera | SOSIP, R6, 664, 201C/433C | BG505 Platform, BG505 Res. Sets C + D, remainder = 89.6.DG | Same as Seq_1172 |
| 1179 | H345 | A03349M1.vrc4a-chim_d7324.201C-433C.mi-cl1-2 | A03349M1.vrc4a/BG505 chimera | SOSIP, R6, 664, 201C/433C | BG505 Platform, BG505 Res. Sets C + D, remainder = A03349M1.vrc4a | Same as Seq_1172 |
| 1180 | H346 | Bal.01-chim_d7324.201C-433C.mi-cl1-2 | Bal.01/BG505 chimera | SOSIP, R6, 664, 201C/433C | BG505 Platform, BG505 Res. Sets C + D, remainder = Bal.01 | Same as Seq_1172 |
| 1181 | H347 | BaL.26-chim_d7324.201C-433C.mi-cl1-2 | BaL.26/BG505 chimera | SOSIP, R6, 664, 201C/433C | BG505 Platform, BG505 Res. Sets C + D, remainder = BaL.26 | Same as Seq_1172 |
| 1182 | H348 | BG1168.01-chim_d7324.201C-433C.mi-cl1-2 | BG1168.01/BG505 chimera | SOSIP, R6, 664, 201C/433C | BG505 Platform, BG505 Res. Sets C + D, remainder = BG1168.01 | Same as Seq_1172 |
| 1183 | H349 | BRO7.DG-chim_d7324.201C-433C.mi-cl1-2 | BRO7.DG/BG505 chimera | SOSIP, R6, 664, 201C/433C | BG505 Platform, BG505 Res. Sets C + D, remainder = BRO7.DG | Same as Seq_1172 |
| 1184 | H350 | CNE10-chim_d7324.201C-433C.mi-cl1-2 | CNE10/BG505 chimera | SOSIP, R6, 664, 201C/433C | BG505 Platform, BG505 Res. Sets C + D, remainder = CNE10 | Same as Seq_1172 |
| 1185 | H351 | CNE30-chim_d7324.201C-433C.mi-cl1-2 | CNE30/BG505 chimera | SOSIP, R6, 664, 201C/433C | BG505 Platform, BG505 Res. Sets C + D, remainder = CNE30 | Same as Seq_1172 |
| 1186 | H352 | CNE4-chim_d7324.201C-433C.mi-cl1-2 | CNE4/BG505 chimera | SOSIP, R6, 664, 201C/433C | BG505 Platform, BG505 Res. Sets C + D, remainder = CNE4 | Same as Seq_1172 |

| SEQ ID NO | Code | Name | Native Background | Mutations Compared to Native Background | Additional mutations | Comment |
|---|---|---|---|---|---|---|
| 1187 | H353 | JRCSF.JB-chim_d7324.201C-433C.mi-cl1-2 | JRCSF.JB/BG505 chimera | SOSIP, R6, 664, 201C/433C | BG505 Platform, BG505 Res. Sets C + D, remainder = JRCSF.JB | Same as Seq_1172 |
| 1188 | H354 | JRFL.JB-chim_d7324.201C-433C.mi-cl1-2 | JRFLIB/BG505 chimera | SOSIP, R6, 664, 201C/433C | BG505 Platform, BG505 Res. Sets C + D, remainder = JRFL.JB | Same as Seq_1172 |
| 1189 | H355 | MB539.2137-chim_d7324.201C-433C.mi-cl1-2 | MB539.2137/BG505 chimera | SOSIP, R6, 664, 201C/433C | BG505 Platform, BG505 Res. Sets C + D, remainder = MB539.267 | Same as Seq_1172 |
| 1190 | H356 | MN.3-chim_d7324.201C-433C.mi-cl1-2 | MN.3/BG505 chimera | SOSIP, R6, 664, 201C/433C | BG505 Platform, BG505 Res. Sets C + D, remainder = MN.3 | Same as Seq_1172 |
| 1191 | H357 | NKU3006.ec1-chim_d7324.201C-433C.mi-cl1-2 | NKU3006.ec1/BG505 chimera | SOSIP, R6, 664, 201C/433C | BG505 Platform, BG505 Res. Sets C + D, remainder = NKU3006.ec1 | Same as Seq_1172 |
| 1192 | H358 | PVO.04-chim_d7324.201C-433C.mi-cl1-2 | PVO.04/BG505 chimera | SOSIP, R6, 664, 201C/433C | BG505 Platform, BG505 Res. Sets C + D, remainder = PVO.04 | Same as Seq_1172 |
| 1193 | H359 | Q259.17-chim_d7324.201C-433C.mi-cl1-2 | Q259.17/BG505 chimera | SOSIP, R6, 664, 201C/433C | BG505 Platform, BG505 Res. Sets C + D, remainder = Q259.17 | Same as Seq_1172 |
| 1194 | H360 | QH0692.42-chim_d7324.201C-433C.mi-cl1-2 | QH0692.42/BG505 chimera | SOSIP, R6, 664, 201C/433C | BG505 Platform, BG505 Res. Sets C + D, remainder = QH0692.42 | Same as Seq_1172 |
| 1195 | H361 | SF162.LS-chim_d7324.201C-433C.mi-cl1-2 | SF162.LS/BG505 chimera | SOSIP, R6, 664, 201C/433C | BG505 Platform, BG505 Res. Sets C + D, remainder = SF162.LS | Same as Seq_1172 |
| 1196 | H362 | SS1196.01-chim_d7324.201C-433C.mi-cl1-2 | SS1196.01/BG505 chimera | SOSIP, R6, 664, 201C/433C | BG505 Platform, BG505 Res. Sets C + D, remainder = SS1196.01 | Same as Seq_1172 |
| 1197 | H363 | T266-60-chim_d7324.201C-433C.mi-cl1-2 | T266-60/BG505 chimera | SOSIP, R6, 664, 201C/433C | BG505 Platform, BG505 Res. Sets C + D, remainder = T266-60 | Same as Seq_1172 |
| 1198 | H364 | T280-5-chim_d7324.201C-433C.mi-cl1-2 | T280-5/BG505 chimera | SOSIP, R6, 664, 201C/433C | BG505 Platform, BG505 Res. Sets C + D, remainder = T280-5 | Same as Seq_1172 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1199 | H365 | UG024.2-chim_d7324_201C-433C_mi-c11-2 | UG024.2/BG505 chimera | SOSIP, R6, 664, 201C/433C | BG505 Platform, BG505 Res. Sets C + D, remainder = UG024.2 | Same as Seq_1172 |
| 1200 | H366 | ZM215.8-chim_d7324_201C-433C_mi-c11-2 | ZM215.8/BG505 chimera | SOSIP, R6, 664, 201C/433C | BG505 Platform, BG505 Res. Sets C + D, remainder = ZM215.8 | Same as Seq_1172 |
| 1201 | H367 | 0921.V2.C14-chim_201C-433C_5ln-ferr | 0921.V2.C14/BG505 chimera | SOSIP, R6, 664, 201C/433C | BG505 Platform, gp140 remainder = 0921.V2.C14, ferritin linked to gp41-C | Same as Seq_1099 |
| 1202 | H368 | 16055-2.3-chim_201C-433C_5ln-ferr | 16055-2.3/BG505 chimera | SOSIP, R6, 664, 201C/433C | BG505 Platform, gp140 remainder = 16055-2.3, ferritin linked to gp41-C | Same as Seq_1099 |
| 1203 | H369 | 286.36-chim_201C-433C_5ln-ferr | 286.36/BG505 chimera | SOSIP, R6, 664, 201C/433C | BG505 Platform, gp140 remainder = 286.36, ferritin linked to gp41-C | Same as Seq_1099 |
| 1204 | H370 | 620345.c1-chim_201C-433C_5ln-ferr | 620345.c1/BG505 chimera | SOSIP, R6, 664, 201C/433C | BG505 Platform, gp140 remainder = 620345.c1, ferritin linked to gp41-C | Same as Seq_1099 |
| 1205 | H371 | 6545.V4.C1-chim_201C-433C_5ln-ferr | 6545.V4.C1/BG505 chimera | SOSIP, R6, 664, 201C/433C | BG505 Platform, gp140 remainder = 6545.V4.C1, ferritin linked to gp41-C | Same as Seq_1099 |
| 1206 | H372 | AC10.29-chim_201C-433C_5ln-ferr | AC10.29/BG505 chimera | SOSIP, R6, 664, 201C/433C | BG505 Platform, gp140 remainder = AC10.29, ferritin linked to gp41-C | Same as Seq_1099 |
| 1207 | H373 | B1369.9A-chim_201C-433C_5ln-ferr | B1369.9A/BG505 chimera | SOSIP, R6, 664, 201C/433C | BG505 Platform, gp140 remainder = B1369.9A, ferritin linked to gp41-C | Same as Seq_1099 |
| 1208 | H374 | C1080.c3-chim_201C-433C_5ln-ferr | C1080.c3/BG505 chimera | SOSIP, R6, 664, 201C/433C | BG505 Platform, gp140 remainder = C1080.c3, ferritin linked to gp41-C | Same as Seq_1099 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1209 | H375 | C4118.09-chim_201C-433C_5ln-ferr | C4118.09/BG505 chimera | SOSIP, R6, 664, 201C/433C | BG505 Platform, gp140 remainder = C4118.09, ferritin linked to gp41-C | Same as Seq_1099 |
| 1210 | H376 | CAP45.G3-chim_201C-433C_5ln-ferr | CAP45.G3/BG505 chimera | SOSIP, R6, 664, 201C/433C | BG505 Platform, gp140 remainder = CAP45.G3, ferritin linked to gp41-C | Same as Seq_1099 |
| 1211 | H377 | CH038.12-chim_201C-433C_5ln-ferr | CH038.12/BG505 chimera | SOSIP, R6, 664, 201C/433C | BG505 Platform, gp140 remainder = CH038.12, ferritin linked to gp41-C | Same as Seq_1099 |
| 1212 | H378 | CH117.4-chim_201C-433C_5ln-ferr | CH117.4/BG505 chimera | SOSIP, R6, 664, 201C/433C | BG505 Platform, gp140 remainder = CH117.4, ferritin linked to gp41-C | Same as Seq_1099 |
| 1213 | H379 | MB201.A1-chim_201C-433C_5ln-ferr | MB201.A1/BG505 chimera | SOSIP, R6, 664, 201C/433C | BG505 Platform, gp140 remainder = MB201.A1, ferritin linked to gp41-C | Same as Seq_1099 |
| 1214 | H380 | MW965.26-chim_201C-433C_5ln-ferr | MW965.26/BG505 chimera | SOSIP, R6, 664, 201C/433C | BG505 Platform, gp140 remainder = MW965.26, ferritin linked to gp41-C | Same as Seq_1099 |
| 1215 | H381 | QH209.14M.A2-chim_201C-433C_5ln-ferr | QH209.14M.A2/BG505 chimera | SOSIP, R6, 664, 201C/433C | BG505 Platform, gp140 remainder = QH209.14M.A2, ferritin linked to gp41-C | Same as Seq_1099 |
| 1216 | H382 | TH966.8-chim_201C-433C_5ln-ferr | TH966.8/BG505 chimera | SOSIP, R6, 664, 201C/433C | BG505 Platform, gp140 remainder = TH966.8, ferritin linked to gp41-C | Same as Seq_1099 |
| 1217 | H383 | ZM106.9-chim_201C-433C_5ln-ferr | ZM106.9/BG505 chimera | SOSIP, R6, 664, 201C/433C | BG505 Platform, gp140 remainder = ZM106.9, ferritin linked to gp41-C | Same as Seq_1099 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1218 | H384 | ZM55.28a-chim_201C-433C_5ln-ferr | ZM55.28a/BG505 chimera | SOSIP, R6, 664, 201C/433C | BG505 Platform, gp140 remainder = ZM55.28a, ferritin linked to gp41-C | Same as Seq_1099 |
| 1219 | 0 | B1369.9A | B1369.9A | | | |
| 1220 | 0 | MB201.A1 | MB201.A1 | | | |
| 1221 | 0 | QH209.14M.A2 | QH209.14M.A2 | | | |
| 1222 | 0 | 0921.V2.C14 | 0921.V2.C14 | | | |
| 1223 | 0 | 16055-2.3 | 16055-2.3 | | | |
| 1224 | 0 | 25925-2.22 | 25925-2.22 | | | |
| 1225 | 0 | 286.36 | 286.36 | | | |
| 1226 | 0 | CAP45.G3 | CAP45.G3 | | | |
| 1227 | 0 | CNE58 | CNE58 | | | |
| 1228 | 0 | DU156.12 | DU156.12 | | | |
| 1229 | 0 | DU422.01 | DU422.01 | | | |
| 1230 | 0 | MW965.26 | MW965.26 | | | |
| 1231 | 0 | ZM53.12 | ZM53.12 | | | |
| 1232 | 0 | ZM55.28a | ZM55.28a | | | |
| 1233 | 0 | ZM106.9 | ZM106.9 | | | |
| 1234 | 0 | 3301.V1.C24 | 3301.V1.C24 | | | |
| 1235 | 0 | 6545.V4.C1 | 6545.V4.C1 | | | |
| 1236 | 0 | 620345.c1 | 620345.c1 | | | |
| 1237 | 0 | C1080.c3 | C1080.c3 | | | |
| 1238 | 0 | C4118.09 | C4118.09 | | | |
| 1239 | 0 | CNE55 | CNE55 | | | |
| 1240 | 0 | TH966.8 | TH966.8 | | | |

| 1 SEQ ID NO | 2 Code | 3 Name | 4 Native Background | 5 Mutations Compared to Native Background | 6 Additional mutations | 7 Comment |
|---|---|---|---|---|---|---|
| 1241 | 0 | AC10.29 | AC10.29 | | | |
| 1242 | 0 | CH038.12 | CH038.12 | | | |
| 1243 | 0 | CH117.4 | CH117.4 | | | |
| 1244 | A347 | *CH505, BG505 chimera, SOSIP.R6.664_I201C/A433C AENLWVTVYYGVPVWKEAKTLFCASDAKAYEKEVHNWATHACVPTDPNPQEMVLKNVTENFNMWKNDMVDQMHEDVISLWDQSLKPCVKLTPLCVTLNCTNATASNSSIIEGMKNCSFNITTELRDKR EKKNALFYKLDIVQLDGNSSQYRLINCNTSVCTQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRP NNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTETNSTRTITIHCRIKQIINMWQEVG RCMYAPPIAGNITCISNITGLLLTRDGGKNNTETFRPGGGNMKDNWRSELYKYKVVKIEPLGVAPTRCKRRVGRRRRRRAVGIGAVFLGFLGAAGSTMGAASMTLTVQARNLLSGIVQQQSNLLRAPEA QQHLLKLTVWGIKQLQARVLAVERYLRDQQLLGIWGCSGKLICCTTNVPWNSSWSNRNLSEIWDNMTWLQWDKEISNYTQIIYGLLEESQNQQEKNEQDLLALD | CH505/BG505 chimera | SOSIP, R6, 664, T332N | I201C/A433C | |
| 1245 | A348 | BG505.SOSIP.R6.664_T332N_I201C/A433C/ V134F/L175M/I322M/I326M | BG505 | SOSIP, R6, 664, T332N, I201C/A433C | V134F/L175M/I322M/I326M | Cavity Filling/Hydrophobic core |
| 1246 | A349 | BG505.SOSIP.R6.664_T332N_I201C/A433C/ V134F/I322Y/I326M | BG505 | Same as Seq_1245 | V134F/I322Y/I326M | Cavity Filling/Hydrophobic core |
| 1247 | A350 | BG505.SOSIP.R6.664_T332N_I201C/A433C/ V134I/L175W/I322F/I326M | BG505 | Same as Seq_1245 | V134I/L175W/I322F/I326M | Cavity Filling/Hydrophobic core |
| 1248 | A351 | BG505.SOSIP.R6.664_T332N_I201C/A433C/ V134F/N136W/M150H/I326M | BG505 | Same as Seq_1245 | V134F/N136W/M150H/I326M | Cavity Filling/Hydrophobic core |
| 1249 | A352 | BG505.SOSIP.R6.664_T332N_I201C/A433C/ V134F/N136W/M150F/I326L | BG505 | Same as Seq_1245 | V134F/N136W/M150F/I326L | Cavity Filling/Hydrophobic core |
| 1250 | A353 | BG505.SOSIP.R6.664_T332N_I201C/A433C/ V134I/N136W/M150F/I326L | BG505 | Same as Seq_1245 | V134I/N136W/M150F/I326L | Cavity Filling/Hydrophobic core |
| 1251 | A354 | BG505.SOSIP.R6.664_T332N_I201C/A433C/ V134F/N136F/M150L/I326M | BG505 | Same as Seq_1245 | V134F/N136F/M150L/I326M | Cavity Filling/Hydrophobic core |
| 1252 | A355 | BG505.SOSIP.R6.664_T332N_I201C/A433C/ L154M/N300M/N302M/T320L | BG505 | Same as Seq_1245 | L154M/N300M/N302M/T320L | Cavity Filling/Hydrophobic core |
| 1253 | A356 | BG505.SOSIP.R6.664_T332N_I201C/A433C/ L154F/N300L/N302L/T320L | BG505 | Same as Seq_1245 | L154F/N300L/N302L/T320L | Cavity Filling/Hydrophobic core |
| 1254 | A357 | BG505.SOSIP.R6.664_T332N_I201C/A433C/ L154W/N300L/N302G/T320F | BG505 | Same as Seq_1245 | L154W/N300L/N302G/T320F | Cavity Filling/Hydrophobic core |

| 1 SEQ ID NO | 2 Code | 3 Name | 4 Native Background | 5 Mutations Compared to Native Background | 6 Additional mutations | 7 Comment |
|---|---|---|---|---|---|---|
| 1255 | A358 | BG505.SOSIP.R6.664.T332N_I201C/A433C/ V120F/Q203M/Y318M | BG505 | Same as Seq_1245 | V120F/Q203M/Y318M | Cavity Filling/Hydrophobic core |
| 1256 | A359 | BG505.SOSIP.R6.664.T332N_I201C/A433C/ V120I/Q203M/Y318W | BG505 | Same as Seq_1245 | V120I/Q203M/Y318W | Cavity Filling/Hydrophobic core |
| 1257 | A360 | BG505.SOSIP.R6.664.T332N_I201C/A433C/ V120W/Q203M/Y318W | BG505 | Same as Seq_1245 | V120W/Q203M/Y318W | Cavity Filling/Hydrophobic core |
| 1258 | A361 | BG505.SOSIP.R6.664.T332N_I201C/A433C/ V120F/Q315M | BG505 | Same as Seq_1245 | V120F/Q315M | Cavity Filling/Hydrophobic core |
| 1259 | A362 | BG505.SOSIP.R6.664.T332N_I201C/A433C/ V120W/Q315F | BG505 | Same as Seq_1245 | V120W/Q315F | Cavity Filling/Hydrophobic core |
| 1260 | A363 | BG505.SOSIP.R6.664.T332N_I201C/A433C/ Y177W/I420M | BG505 | Same as Seq_1245 | Y177W/I420M | Cavity Filling/Hydrophobic core |
| 1261 | A364 | BG505.SOSIP.R6.664.T332N_I201C/A433C/ Y177W/Q328F/I420M | BG505 | Same as Seq_1245 | Y177W/Q328F/I420M | Cavity Filling/Hydrophobic core |
| 1262 | A365 | BG505.SOSIP.R6.664.T332N_I201C/A433C/ L116M/M426F/Q432M | BG505 | Same as Seq_1245 | L116M/M426F/Q432M | Cavity Filling/Hydrophobic core |
| 1263 | A366 | BG505.SOSIP.R6.664.T332N_I201C/A433C/ L116M/M426F/Q432W | BG505 | Same as Seq_1245 | L116M/M426F/Q432W | Cavity Filling/Hydrophobic core |
| 1264 | A367 | BG505.SOSIP.R6.664.T332N_I201C/A433C/ M426F/Q432L | BG505 | Same as Seq_1245 | M426F/Q432L | Cavity Filling/Hydrophobic core |
| 1265 | A368 | BG505.SOSIP.R6.664.T332N_I201C/A433C/ V134F/L175M/I322M/I326M/N136W/M150H | BG505 | Same as Seq_1245 | V134F/L175M/I322M/I326M/ N136W/M150H | Cavity Filling/Hydrophobic core |
| 1266 | A369 | BG505.SOSIP.R6.664.T332N_I201C/A433C/ V134I/L175W/I322F/I326L/N136W/M150F | BG505 | Same as Seq_1245 | V134I/L175W/I322F/I326L/ N136W/M150F | Cavity Filling/Hydrophobic core |
| 1267 | A370 | BG505.SOSIP.R6.664.T332N_I201C/A433C/ V120F/Q203M/Y318M/Q315M | BG505 | Same as Seq_1245 | V120F/Q203M/Y318M/Q315M | Cavity Filling/Hydrophobic core |
| 1268 | A371 | BG505.SOSIP.R6.664.T332N_I201C/A433C/ V120W/Q203M/Y318W/Q315F | BG505 | Same as Seq_1245 | V120W/Q203M/Y318W/Q315F | Cavity Filling/Hydrophobic core |
| 1269 | A372 | BG505.SOSIP.R6.664.T332N_I201C/A433C/ L154M/N300M/N302M/T320L/Y177W/I420M | BG505 | Same as Seq_1245 | L154M/N300M/N302M/T320L/ Y177W/I420M | Cavity Filling/Hydrophobic core |
| 1270 | A373 | BG505.SOSIP.R6.664.T332N_I201C/A433C/ L154W/N300L/N302G/T320F/Y177W/Q328F/ I420M | BG505 | Same as Seq_1245 | L154W/N300L/N302G/T320F/ Y177W/Q328F/I420M | Cavity Filling/Hydrophobic core |

-continued

| SEQ ID NO | Code | Name | Native Background | Mutations Compared to Native Background | Additional mutations | Comment |
|---|---|---|---|---|---|---|
| 1271 | A374 | BG505.SOSIP.R6.664.T332N_I201C/A433C/E153F | BG505 | Same as Seq_1245 | E153F | Cavity Filling |
| 1272 | A375 | BG505.SOSIP.R6.664.T332N_I201C/A433C/E153W | BG505 | Same as Seq_1245 | E153W | Cavity Filling |
| 1273 | A376 | BG505.SOSIP.R6.664.T332N_I201C/A433C/L154F | BG505 | Same as Seq_1245 | L154F | Cavity Filling |
| 1274 | A377 | BG505.SOSIP.R6.664.T332N_I201C/A433C/L154W | BG505 | Same as Seq_1245 | L154W | Cavity Filling |
| 1275 | A378 | BG505.SOSIP.R6.664.T332N_I201C/A433C/E164F | BG505 | Same as Seq_1245 | E164F | Cavity Filling |
| 1276 | A379 | BG505.SOSIP.R6.664.T332N_I201C/A433C/E164W | BG505 | Same as Seq_1245 | E164W | Cavity Filling |
| 1277 | A380 | BG505.SOSIP.R6.664.T332N_I201C/A433C/V172F | BG505 | Same as Seq_1245 | V172F | Cavity Filling |
| 1278 | A381 | BG505.SOSIP.R6.664.T332N_I201C/A433C/V172W | BG505 | Same as Seq_1245 | V172W | Cavity Filling |
| 1279 | A382 | BG505.SOSIP.R6.664.T332N_I201C/A433C/L175F | BG505 | Same as Seq_1245 | L175F | Cavity Filling |
| 1280 | A383 | BG505.SOSIP.R6.664.T332N_I201C/A433C/F176W | BG505 | Same as Seq_1245 | F176W | Cavity Filling |
| 1281 | A384 | BG505.SOSIP.R6.664.T332N_I201C/A433C/L179F | BG505 | Same as Seq_1245 | L179F | Cavity Filling |
| 1282 | A385 | BG505.SOSIP.R6.664.T332N_I201C/A433C/L179W | BG505 | Same as Seq_1245 | L179W | Cavity Filling |
| 1283 | A386 | BG505.SOSIP.R6.664.T332N_I201C/A433C/Y191F | BG505 | Same as Seq_1245 | Y191F | Cavity Filling |
| 1284 | A387 | BG505.SOSIP.R6.664.T332N_I201C/A433C/Y191W | BG505 | Same as Seq_1245 | Y191W | Cavity Filling |
| 1285 | A388 | BG505.SOSIP.R6.664.T332N_I201C/A433C/L193F | BG505 | Same as Seq_1245 | L193F | Cavity Filling |
| 1286 | A389 | BG505.SOSIP.R6.664.T332N_I201C/A433C/L193W | BG505 | Same as Seq_1245 | L193W | Cavity Filling |

| 1 SEQ ID NO | 2 Code | 3 Name | 4 Native Background | 5 Mutations Compared to Native Background | 6 Additional mutations | 7 Comment |
|---|---|---|---|---|---|---|
| 1287 | A390 | BG505.SOSIP.R6.664.T332N_I201C/A433C/I194W | BG505 | Same as Seq_1245 | I194W | Cavity Filling |
| 1288 | A391 | BG505.SOSIP.R6.664.T332N_I201C/A433C/T198F | BG505 | Same as Seq_1245 | T198F | Cavity Filling |
| 1289 | A392 | BG505.SOSIP.R6.664.T332N_I201C/A433C/T198W | BG505 | Same as Seq_1245 | T198W | Cavity Filling |
| 1290 | A393 | BG505.SOSIP.R6.664.T332N_I201C/A433C/T202F | BG505 | Same as Seq_1245 | T202F | Cavity Filling |
| 1291 | A394 | BG505.SOSIP.R6.664.T332N_I201C/A433C/T202W | BG505 | Same as Seq_1245 | T202W | Cavity Filling |
| 1292 | A395 | BG505.SOSIP.R6.664.T332N_I201C/A433C/A204F | BG505 | Same as Seq_1245 | A204F | Cavity Filling |
| 1293 | A396 | BG505.SOSIP.R6.664.T332N_I201C/A433C/A204W | BG505 | Same as Seq_1245 | A204W | Cavity Filling |
| 1294 | A397 | BG505.SOSIP.R6.664.T332N_I201C/A433C/N302F | BG505 | Same as Seq_1245 | N302F | Cavity Filling |
| 1295 | A398 | BG505.SOSIP.R6.664.T332N_I201C/A433C/N302W | BG505 | Same as Seq_1245 | N302W | Cavity Filling |
| 1296 | A399 | BG505.SOSIP.R6.664.T332N_I201C/A433C/R304F | BG505 | Same as Seq_1245 | R304F | Cavity Filling |
| 1297 | A400 | BG505.SOSIP.R6.664.T332N_I201C/A433C/R304W | BG505 | Same as Seq_1245 | R304W | Cavity Filling |
| 1298 | A401 | BG505.SOSIP.R6.664.T332N_I201C/A433C/I307F | BG505 | Same as Seq_1245 | I307F | Cavity Filling |
| 1299 | A402 | BG505.SOSIP.R6.664.T332N_I201C/A433C/I307W | BG505 | Same as Seq_1245 | I307W | Cavity Filling |
| 1300 | A403 | BG505.SOSIP.R6.664.T332N_I201C/A433C/Q315F | BG505 | Same as Seq_1245 | Q315F | Cavity Filling |
| 1301 | A404 | BG505.SOSIP.R6.664.T332N_I201C/A433C/Q315W | BG505 | Same as Seq_1245 | Q315W | Cavity Filling |
| 1302 | A405 | BG505.SOSIP.R6.664.T332N_I201C/A433C/I423F | BG505 | Same as Seq_1245 | I423F | Cavity Filling |

-continued

| SEQ ID NO | Code | Name | Native Background | Mutations Compared to Native Background | Additional mutations | Comment |
|---|---|---|---|---|---|---|
| 1303 | A406 | BG505.SOSIP.R6.664.T332N_I201C/A433C/I430F | BG505 | Same as Seq_1245 | I430F | Cavity Filling |
| 1304 | A407 | BG505.SOSIP.R6.664.T332N_I201C/A433C/I430W | BG505 | Same as Seq_1245 | I430W | Cavity Filling |
| 1305 | A408 | BG505.SOSIP.R6.664.T332N_I201C/A433C/Q432F | BG505 | Same as Seq_1245 | Q432F | Cavity Filling |
| 1306 | A409 | BG505.SOSIP.R6.664.T332N_I201C/A433C/Q432W | BG505 | Same as Seq_1245 | Q432W | Cavity Filling |
| 1307 | A410 | BG505.SOSIP.R6.664.T332N_I201C/A433C/A436M | BG505 | Same as Seq_1245 | A436M | Cavity Filling |
| 1308 | A411 | BG505.SOSIP.R6.664.T332N_I201C/A433C/A436F | BG505 | Same as Seq_1245 | A436F | Cavity Filling |
| 1309 | A412 | BG505.SOSIP.R6.664.T332N_I201C/A433C/A436W | BG505 | Same as Seq_1245 | A436W | Cavity Filling |
| 1310 | A413 | BG505.SOSIP.R6.664.T332N_I201C/A433C/L125W/I194W | BG505 | Same as Seq_1245 | L125W/I194W | Cavity Filling |
| 1311 | A414 | BG505.SOSIP.R6.664.T332N_I201C/A433C/T139W/D140I/G324I/D325W | BG505 | Same as Seq_1245 | T139W/D140I/G324I/D325W | Cavity Filling |
| 1312 | A415 | BG505.SOSIP.R6.664.T332N_I201C/A433C/F210A | BG505 | Same as Seq_1245 | F210A | Destabilization of CD4-induced conformation |
| 1313 | A416 | BG505.SOSIP.R6.664.T332N_I201C/A433C/F210S | BG505 | Same as Seq_1245 | F210S | Destabilization of CD4-induced conformation |
| 1314 | A417 | BG505.SOSIP.R6.664.T332N_I201C/A433C/Q432P | BG505 | Same as Seq_1245 | Q432P | Destabilization of CD4-induced conformation |
| 1315 | A418 | BG505.SOSIP.R6.664.T332N_I201C/A433C/T538C/Q652C | BG505 | Same as Seq_1245 | T538C/Q652C | Disulfide |
| 1316 | A419 | BG505.SOSIP.R6.664.T332N_I201C/A433C/R304C/Q440C | BG505 | Same as Seq_1245 | R304C/Q440C | Disulfide |
| 1317 | A420 | BG505.SOSIP.R6.664.T332N_I201C/A433C/F159Y | BG505 | Same as Seq_1245 | F159Y | Cavity Filling |
| 1318 | A421 | BG505.SOSIP.R6.664.T332N_I201C/A433C/I323Y | BG505 | Same as Seq_1245 | I323Y | Cavity Filling |

-continued

| SEQ ID NO | Code | Name | Native Background | Mutations Compared to Native Background | Additional mutations | Comment |
|---|---|---|---|---|---|---|
| 1319 | A422 | BG505.SOSIP.R6.664.T332N_I201C/A433C/F159Y/I323Y | BG505 | Same as Seq_1245 | F159Y/I323Y | Cavity Filling |
| 1320 | A423 | BG505.SOSIP.R6.664.T332N_I201C/A433C/F223W | BG505 | Same as Seq_1245 | F223W | Cavity Filling |
| 1321 | A424 | BG505.SOSIP.R6.664.T332N_I201C/A433C/V580L | BG505 | Same as Seq_1245 | V580L | Cavity Filling |
| 1322 | A425 | BG505.SOSIP.R6.664.T332N_I201C/A433C/V583L | BG505 | Same as Seq_1245 | V583L | Cavity Filling |
| 1323 | A426 | BG505.SOSIP.R6.664.T332N_I201C/A433C/V580L/V583L | BG505 | Same as Seq_1245 | V580L/V583L | Cavity Filling |
| 1324 | A427 | BG505.SOSIP.R6.664.T332N_I201C/A433C/W69P | BG505 | Same as Seq_1245 | W69P | helix 0 disruption |
| 1325 | A428 | BG505.SOSIP.R6.664.T332N_I201C/A433C/V68P | BG505 | Same as Seq_1245 | V68P | helix 0 disruption |
| 1326 | A429 | BG505.SOSIP.R6.664.T332N_I201C/A433C/T71P | BG505 | Same as Seq_1245 | T71P | helix 0 disruption |
| 1327 | A430 | BG505.SOSIP.R6.664.T332N_I201C/A433C/V75W | BG505 | Same as Seq_1245 | V75W | Cavity Filling |
| 1328 | A431 | BG505.SOSIP.R6.664.T332N_I201C/A433C/V75F | BG505 | Same as Seq_1245 | V75F | Cavity Filling |
| 1329 | A432 | BG505.SOSIP.R6.664.T332N_I201C/A433C/V75M | BG505 | Same as Seq_1245 | V75M | Cavity Filling |
| 1330 | A433 | BG505.SOSIP.R6.664.T332N_I201C/A433C/V208W | BG505 | Same as Seq_1245 | V208W | Cavity Filling |
| 1331 | A434 | BG505.SOSIP.R6.664.T332N_I201C/A433C/V208F | BG505 | Same as Seq_1245 | V208F | Cavity Filling |
| 1332 | A435 | BG505.SOSIP.R6.664.T332N_I201C/A433C/A58C/T77C | BG505 | Same as Seq_1245 | A58C/T77C | Disulfide |
| 1333 | A436 | BG505.SOSIP.R6.664.T332N_I201C/A433C/D57C/T77C | BG505 | Same as Seq_1245 | D57C/T77C | Disulfide |
| 1334 | A437 | BG505.SOSIP.R6.664.T332N_I201C/A433C/N67P | BG505 | Same as Seq_1245 | N67P | helix 0 disruption |

-continued

| SEQ ID NO | Code | Name | Native Background | Mutations Compared to Native Background | Additional mutations | Comment |
|---|---|---|---|---|---|---|
| 1335 | A438 | BG505.SOSIP.R6.664.T332N_I201C/A433C/ H66P | BG505 | Same as Seq_1245 | H66P | helix 0 disruption |
| 1336 | A439 | BG505.SOSIP.R6.664.T332N_I201C/A433C/ N67P/H66P | BG505 | Same as Seq_1245 | N67P/H66P | helix 0 disruption |
| 1337 | A440 | BG505.SOSIP.R6.664.T332N_I201C/A433C/ W112I | BG505 | Same as Seq_1245 | W112I | Cavity Filling |
| 1338 | A441 | BG505.SOSIP.R6.664.T332N_I201C/A433C/ W112M | BG505 | Same as Seq_1245 | W112M | Cavity Filling |
| 1339 | A442 | BG505.SOSIP.R6.664.T332N_I201C/A433C/ W427I | BG505 | Same as Seq_1245 | W427I | Cavity Filling |
| 1340 | A443 | BG505.SOSIP.R6.664.T332N_I201C/A433C/ W427M | BG505 | Same as Seq_1245 | W427M | Cavity Filling |
| 1341 | A444 | BG505.SOSIP.R6.664.T332N_I201C/A433C/ R429N | BG505 | Same as Seq_1245 | R429N | Destabilization of CD4 binding site |
| 1342 | A445 | BG505.SOSIP.R6.664.T332N_I201C/A433C/ R429L | BG505 | Same as Seq_1245 | R429L | Destabilization of CD4 binding site |
| 1343 | A446 | BG505.SOSIP.R6.664.T332N_I201C/A433C/ R429L/W427M | BG505 | Same as Seq_1245 | R429L/W427M | Destabilization of CD4 binding site |
| 1344 | A447 | BG505.SOSIP.R6.664.T332N_I201C/A433C/ G431GC/S199C | BG505 | Same as Seq_1245 | G431GC/S199C | Disulfide |
| 1345 | A448 | BG505.SOSIP.R6.664.T332N_I201C/A433C/ V120W | BG505 | Same as Seq_1245 | V120W | Cavity Filling |
| 1346 | A449 | BG505.SOSIP.R6.664.T332N_I201C/A433C/ A316W | BG505 | Same as Seq_1245 | A316W | Cavity Filling |
| 1347 | A450 | BG505.SOSIP.R6.664.T332N_I201C/A433C/ I309W | BG505 | Same as Seq_1245 | I309W | Cavity Filling |
| 1348 | A451 | BG505.SOSIP.R6.664.T332N_I201C/A433C/ S115W | BG505 | Same as Seq_1245 | S115W | Cavity Filling |
| 1349 | A452 | BG505.SOSIP.R6.664.T332N_I201C/A433C/ P118W | BG505 | Same as Seq_1245 | P118W | Cavity Filling |
| 1350 | A453 | BG505.SOSIP.R6.664.T332N_I201C/A433C/ A70Y | BG505 | Same as Seq_1245 | A70Y | Cavity Filling |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1351 | A454 | BG505.SOSIP.R6.664.T332N_I201C/A433C/ A70F | BG505 | Same as Seq_1245 | A70F | Cavity Filling |
| 1352 | A455 | BG505.SOSIP.R6.664.T332N_I201C/A433C/ L111Y | BG505 | Same as Seq_1245 | L111Y | Cavity Filling |
| 1353 | A456 | BG505.SOSIP.R6.664.T332N_I201C/A433C/ L111F | BG505 | Same as Seq_1245 | L111F | Cavity Filling |
| 1354 | A457 | BG505.SOSIP.R6.664.T332N_I201C/A433C/ T202P | BG505 | Same as Seq_1245 | T202P | disrupt bridging sheet/ destabilizing CD4 bound state |
| 1355 | A458 | BG505.SOSIP.R6.664.T332N_I201C/A433C/ V120T | BG505 | Same as Seq_1245 | V120T | disrupt bridging sheet/ destabilizing CD4 bound state |
| 1356 | A459 | BG505.SOSIP.R6.664.T332N_I201C/A433C/ I573T | BG505 | Same as Seq_1245 | I573T | destabilize gp41 helix bundle |
| 1357 | A460 | BG505.SOSIP.R6.664.T332N_I201C/A433C/ G594N | BG505 | Same as Seq_1245 | G594N | destabilize gp41 helix bundle |
| 1358 | A461 | BG505.SOSIP.R6.664.T332N_I201C/A433C/ I573T/G594N | BG505 | Same as Seq_1245 | I573T/G594N | destabilize gp41 helix bundle |
| 1359 | A462 | BG505.SOSIP.R6.664.T332N_I201C/A433C/ I573T/G594N/K574E | BG505 | Same as Seq_1245 | I573T/G594N/K574E | destabilize gp41 helix bundle |
| 1360 | A463 | BG505.SOSIP.R6.664.T332N_I201C/A433C/ I573T/G594N/K574T | BG505 | Same as Seq_1245 | I573T/G594N/K574T | destabilize gp41 helix bundle |
| 1361 | A464 | BG505.SOSIP.R6.664.T332N_I201C/A433C/ K117W | BG505 | Same as Seq_1245 | K117W | Cavity Filling |
| 1362 | A465 | BG505.SOSIP.R6.664.T332N_I201C/A433C/ S110W | BG505 | Same as Seq_1245 | S110W | Cavity Filling |
| 1363 | A466 | BG505.SOSIP.R6.664.T332N_I201C/A433C/ L544Y | BG505 | Same as Seq_1245 | L544Y | Cavity Filling |
| 1364 | A467 | BG505.SOSIP.R6.664.T332N_I201C/A433C/ L544Y/L537Y | BG505 | Same as Seq_1245 | L544Y/L537Y | Cavity Filling |
| 1365 | A468 | BG505.SOSIP.R6.664.T332N_I201C/A433C/ L544Y/F223W | BG505 | Same as Seq_1245 | L544Y/F223W | Cavity Filling |
| 1366 | A469 | BG505.SOSIP.R6.664.T332N_I201C/A433C/ L544Y/L537Y/F223W | BG505 | Same as Seq_1245 | L544Y/L537Y/F223W | Cavity Filling |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1367 | A470 | BG505.SOSIP.R6.664.T332N_I201C/A433C/Delta_P206 | BG505 | Same as Seq_1245 | Delta P206 | proline removal. Removal of ground state destabilization/flexibility |
| 1368 | A471 | BG505.SOSIP.R6.664.T332N_I194W/T198M/N425F | BG505 | SOSIP, R6, 664, T332N | I194W/T198M/N425F | Cavity Filling/Hydrophobic core |
| 1369 | A472 | BG505.SOSIP.R6.664.T332N_T198M/N425F | BG505 | SOSIP, R6, 664, T332N | T198M/N425F | Cavity Filling/Hydrophobic core |
| 1370 | A473 | BG505.SOSIP.R6.664.T332N_I194W/T198Y/N425F | BG505 | SOSIP, R6, 664, T332N | I194W/T198Y/N425F | Cavity Filling/Hydrophobic core |
| 1371 | A474 | BG505.SOSIP.R6.664.T332N_I194F/T198L/N425W | BG505 | SOSIP, R6, 664, T332N | I194F/T198L/N425W | Cavity Filling/Hydrophobic core |
| 1372 | A475 | BG505.SOSIP.R6.664.T332N_V134F/L175M/I322M/I326M | BG505 | SOSIP, R6, 664, T332N | V134F/L175M/I322M/I326M | Cavity Filling/Hydrophobic core |
| 1373 | A476 | BG505.SOSIP.R6.664.T332N_V134F/I322Y/I326M | BG505 | SOSIP, R6, 664, T332N | V134F/I322Y/I326M | Cavity Filling/Hydrophobic core |
| 1374 | A477 | BG505.SOSIP.R6.664.T332N_V134I/L175W/I322F/I326M | BG505 | SOSIP, R6, 664, T332N | V134I/L175W/I322F/I326M | Cavity Filling/Hydrophobic core |
| 1375 | A478 | BG505.SOSIP.R6.664.T332N_V134F/N136W/M150H/I326M | BG505 | SOSIP, R6, 664, T332N | V134F/N136W/M150H/I326M | Cavity Filling/Hydrophobic core |
| 1376 | A479 | BG505.SOSIP.R6.664.T332N_V134F/N136W/M150F/I326L | BG505 | SOSIP, R6, 664, T332N | V134F/N136W/M150F/I326L | Cavity Filling/Hydrophobic core |
| 1377 | A480 | BG505.SOSIP.R6.664.T332N_V134I/N136W/M150F/I326L | BG505 | SOSIP, R6, 664, T332N | V134I/N136W/M150F/I326L | Cavity Filling/Hydrophobic core |
| 1378 | A481 | BG505.SOSIP.R6.664.T332N_V134F/N136F/M150L/I326M | BG505 | SOSIP, R6, 664, T332N | V134F/N136F/M150L/I326M | Cavity Filling/Hydrophobic core |
| 1379 | A482 | BG505.SOSIP.R6.664.T332N_L154M/N300M/N302M/T320L | BG505 | SOSIP, R6, 664, T332N | L154M/N300M/N302M/T320L | Cavity Filling/Hydrophobic core |
| 1380 | A483 | BG505.SOSIP.R6.664.T332N_L154F/N300L/N302M/T320L | BG505 | SOSIP, R6, 664, T332N | L154F/N300L/N302M/T320L | Cavity Filling/Hydrophobic core |
| 1381 | A484 | BG505.SOSIP.R6.664.T332N_L154W/N300L/N302G/T320F | BG505 | SOSIP, R6, 664, T332N | L154W/N300L/N302G/T320F | Cavity Filling/Hydrophobic core |
| 1382 | A485 | BG505.SOSIP.R6.664.T332N_V120F/Q203M/Y318M | BG505 | SOSIP, R6, 664, T332N | V120F/Q203M/Y318M | Cavity Filling/Hydrophobic core |

| 1 SEQ ID NO | 2 Code | 3 Name | 4 Native Background | 5 Mutations Compared to Native Background | 6 Additional mutations | 7 Comment |
|---|---|---|---|---|---|---|
| 1383 | A486 | BG505.SOSIP.R6.664.T332N_V120I/Q203M/Y318W | BG505 | SOSIP, R6, 664, T332N | V120I/Q203M/Y318W | Cavity Filling/Hydrophobic core |
| 1384 | A487 | BG505.SOSIP.R6.664.T332N_V120W/Q203M/Y318W | BG505 | SOSIP, R6, 664, T332N | V120W/Q203M/Y318W | Cavity Filling/Hydrophobic core |
| 1385 | A488 | BG505.SOSIP.R6.664.T332N_V120F/Q315M | BG505 | SOSIP, R6, 664, T332N | V120F/Q315M | Cavity Filling/Hydrophobic core |
| 1386 | A489 | BG505.SOSIP.R6.664.T332N_V120W/Q315F | BG505 | SOSIP, R6, 664, T332N | V120W/Q315F | Cavity Filling/Hydrophobic core |
| 1387 | A490 | BG505.SOSIP.R6.664.T332N_Y177W/I420M | BG505 | SOSIP, R6, 664, T332N | Y177W/I420M | Cavity Filling/Hydrophobic core |
| 1388 | A491 | BG505.SOSIP.R6.664.T332N_Y177W/Q328F/I420M | BG505 | SOSIP, R6, 664, T332N | Y177W/Q328F/I420M | Cavity Filling/Hydrophobic core |
| 1389 | A492 | BG505.SOSIP.R6.664.T332N_L116M/M426F/Q432M | BG505 | SOSIP, R6, 664, T332N | L116M/M426F/Q432M | Cavity Filling/Hydrophobic core |
| 1390 | A493 | BG505.SOSIP.R6.664.T332N_L116M/M426F/Q432W | BG505 | SOSIP, R6, 664, T332N | L116M/M426F/Q432W | Cavity Filling/Hydrophobic core |
| 1391 | A494 | BG505.SOSIP.R6.664.T332N_M426F/Q432L | BG505 | SOSIP, R6, 664, T332N | M426F/Q432L | Cavity Filling/Hydrophobic core |
| 1392 | A495 | BG505.SOSIP.R6.664.T332N_V134F/L175M/I322M/I326M/N136W/M150H | BG505 | SOSIP, R6, 664, T332N | V134F/L175M/I322M/I326M/N136W/M150H | Cavity Filling/Hydrophobic core |
| 1393 | A496 | BG505.SOSIP.R6.664.T332N_V134I/L175W/I322F/I326L/N136L/M150F | BG505 | SOSIP, R6, 664, T332N | V134I/L175W/I322F/I326L/N136L/M150F | Cavity Filling/Hydrophobic core |
| 1394 | A497 | BG505.SOSIP.R6.664.T332N_V120F/Q203M/Y318W/Q315M | BG505 | SOSIP, R6, 664, T332N | V120F/Q203M/Y318W/Q315M | Cavity Filling/Hydrophobic core |
| 1395 | A498 | BG505.SOSIP.R6.664.T332N_V120W/Q203M/Y318W/Q315F | BG505 | SOSIP, R6, 664, T332N | V120W/Q203M/Y318W/Q315F | Cavity Filling/Hydrophobic core |
| 1396 | A499 | BG505.SOSIP.R6.664.T332N_L154M/N300M/N302M/T320L/Y177W/I420M | BG505 | SOSIP, R6, 664, T332N | L154M/N300M/N302M/T320L/Y177W/I420M | Cavity Filling/Hydrophobic core |
| 1397 | A500 | BG505.SOSIP.R6.664.T332N_L154W/N300L/N302G/T320F/Y177W/Q328F/I420M | BG505 | SOSIP, R6, 664, T332N | L154W/N300L/N302G/T320F/Y177W/Q328F/I420M | Cavity Filling/Hydrophobic core |
| 1398 | A501 | 703010505.TF.sosip_d7324_R6_664_I201C/A433C | 703010505.TF | SOSIP, R6, 664 | I201C/A433C | |
| 1399 | A502 | 703010505.TF.sosip_d7324_tad_R6_664_I201C/A433C/E47D/K49E/V65K/E106T/E429R/R432Q/E500R | 703010505.TF | SOSIP, R6, 664 | I201C/A433C | trimer association domain mutations |

-continued

| SEQ ID NO | Code | Name | Native Background | Mutations Compared to Native Background | Additional mutations | Comment |
|---|---|---|---|---|---|---|
| 1400 | A503 | 286.36.sosip_d7324 | 286.36 | SOSIP, R6, 664 | I201C/A433C | |
| 1401 | A504 | 288.38.sosip_d7324 | 288.38 | SOSIP, R6, 664 | I201C/A433C | |
| 1402 | A505 | 3988.25.sosip_d7324 | 3988.25 | SOSIP, R6, 664 | I201C/A433C | |
| 1403 | A506 | 5768.04.sosip_d7324 | 5768.04 | SOSIP, R6, 664 | I201C/A433C | |
| 1404 | A507 | 6101.1.sosip_d7324 | 6101.1 | SOSIP, R6, 664 | I201C/A433C | |
| 1405 | A508 | 6535.3.sosip_d7324 | 6535.3 | SOSIP, R6, 664 | I201C/A433C | |
| 1406 | A509 | 7165.18.sosip_d7324 | 7165.18 | SOSIP, R6, 664 | I201C/A433C | |
| 1407 | A510 | 00130952.11.sosip_d7324 | 00130952.11 | SOSIP, R6, 664 | I201C/A433C | |
| 1408 | A511 | 0014282.42.sosip_d7324 | 0014282.42 | SOSIP, R6, 664 | I201C/A433C | |
| 1409 | A512 | 0077_V1.C16.sosip_d7324 | 0077_V1.C16 | SOSIP, R6, 664 | I201C/A433C | |
| 1410 | A513 | 008362.5.sosip_d7324 | 8362.5 | SOSIP, R6, 664 | I201C/A433C | |
| 1411 | A514 | 0260.v5.c36.sosip_d7324 | 0260.v5.c36 | SOSIP, R6, 664 | I201C/A433C | |
| 1412 | A515 | 0330.v4.c3.sosip_d7324 | 0330.v4.c3 | SOSIP, R6, 664 | I201C/A433C | |
| 1413 | A516 | 0439.v5.c1.sosip_d7324 | 0439.v5.c1 | SOSIP, R6, 664 | I201C/A433C | |
| 1414 | A517 | 0815.V3.C3.sosip_d7324 | 0815.V3.C3 | SOSIP, R6, 664 | I201C/A433C | |
| 1415 | A518 | 0921.V2.C14.sosip_d7324 | 0921.V2.C14 | SOSIP, R6, 664 | I201C/A433C | |
| 1416 | A519 | 160552.3.sosip_d7324 | 160552.3 | SOSIP, R6, 664 | I201C/A433C | |
| 1417 | A520 | 168452.22.sosip_d7324 | 168452.22 | SOSIP, R6, 664 | I201C/A433C | |
| 1418 | A521 | 169362.21.sosip_d7324 | 169362.21 | SOSIP, R6, 664 | I201C/A433C | |
| 1419 | A522 | 231965.c1.sosip_d7324 | 231965.c1 | SOSIP, R6, 664 | I201C/A433C | |
| 1420 | A523 | 23547.sosip_d7324 | 23547 | SOSIP, R6, 664 | I201C/A433C | |
| 1421 | A524 | 24214.sosip_d7324 | 24214 | SOSIP, R6, 664 | I201C/A433C | |
| 1422 | A525 | 24723.sosip_d7324 | 24723 | SOSIP, R6, 664 | I201C/A433C | |
| 1423 | A526 | 257102.43.sosip_d7324 | 257102.43 | SOSIP, R6, 664 | I201C/A433C | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1424 | A527 | 257112.4.sosip_d7324 | 257112.4 | SOSIP, R6, 664 | I201C/A433C | |
| 1425 | A528 | 259252.22.sosip_d7324 | 259252.22 | SOSIP, R6, 664 | I201C/A433C | |
| 1426 | A529 | 261912.48.sosip_d7324 | 261912.48 | SOSIP, R6, 664 | I201C/A433C | |
| 1427 | A530 | 2638.sosip_d7324 | 2638 | SOSIP, R6, 664 | I201C/A433C | |
| 1428 | A531 | 26912.sosip_d7324 | 26912 | SOSIP, R6, 664 | I201C/A433C | |
| 1429 | A532 | 27111.sosip_d7324 | 27111 | SOSIP, R6, 664 | I201C/A433C | |
| 1430 | A533 | 3016.v5.c45.sosip_d7324 | 3016.v5.c45 | SOSIP, R6, 664 | I201C/A433C | |
| 1431 | A534 | 3168.V4.C10.sosip_d7324 | 3168.V4.C10 | SOSIP, R6, 664 | I201C/A433C | |
| 1432 | A535 | 3301.V1.C24.sosip_d7324 | 3301.V1.C24 | SOSIP, R6, 664 | I201C/A433C | |
| 1433 | A536 | 3326.V4.C3.sosip_d7324 | 3326.V4.C3 | SOSIP, R6, 664 | I201C/A433C | |
| 1434 | A537 | 3337.V2.C6.sosip_d7324 | 3337.V2.C6 | SOSIP, R6, 664 | I201C/A433C | |
| 1435 | A538 | 3365.v2.c20.sosip_d7324 | 3365.v2.c20 | SOSIP, R6, 664 | I201C/A433C | |
| 1436 | A539 | 3415.v1.c1.sosip_d7324 | 3415.v1.c1 | SOSIP, R6, 664 | I201C/A433C | |
| 1437 | A540 | 3468.V1.C12.sosip_d7324 | 3468.V1.C12 | SOSIP, R6, 664 | I201C/A433C | |
| 1438 | A541 | 3589.V1.C4.sosip_d7324 | 3589.V1.C4 | SOSIP, R6, 664 | I201C/A433C | |
| 1439 | A542 | 3637.V5.C3.sosip_d7324 | 3637.V5.C3 | SOSIP, R6, 664 | I201C/A433C | |
| 1440 | A543 | 3718.v3.c11.sosip_d7324 | 3718.v3.c11 | SOSIP, R6, 664 | I201C/A433C | |
| 1441 | A544 | 3817.v2.c59.sosip_d7324 | 3817.v2.c59 | SOSIP, R6, 664 | I201C/A433C | |
| 1442 | A545 | 3873.V1.C24.sosip_d7324 | 3873.V1.C24 | SOSIP, R6, 664 | I201C/A433C | |
| 1443 | A546 | 398F1_F6_20.sosip_d7324 | 398F1_F6_20 | SOSIP, R6, 664 | I201C/A433C | |
| 1444 | A547 | 57128.vrc15.sosip_d7324 | 57128.vrc15 | SOSIP, R6, 664 | I201C/A433C | |
| 1445 | A548 | 6095.V1.C10.sosip_d7324 | 6095.V1.C10 | SOSIP, R6, 664 | I201C/A433C | |
| 1446 | A549 | 620345.c1.sosip_d7324 | 620345.c1 | SOSIP, R6, 664 | I201C/A433C | |
| 1447 | A550 | 6322.V4.C1.sosip_d7324 | 6322.V4.C1 | SOSIP, R6, 664 | I201C/A433C | |
| 1448 | A551 | 6405.v4.c34.sosip_d7324 | 6405.v4.c34 | SOSIP, R6, 664 | I201C/A433C | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1449 | A552 | 6471.V1.C16.sosip_d7324 | 6471.V1.C16 | SOSIP, R6, 664 | I201C/A433C | |
| 1450 | A553 | 6540.v4.c1.sosip_d7324 | 6540.v4.c1 | SOSIP, R6, 664 | I201C/A433C | |
| 1451 | A554 | 6545.V3.C13.sosip_d7324 | 6545.V3.C13 | SOSIP, R6, 664 | I201C/A433C | |
| 1452 | A555 | 6545.V4.C1.sosip_d7324 | 6545.V4.C1 | SOSIP, R6, 664 | I201C/A433C | |
| 1453 | A556 | 6631.V3.C10.sosip_d7324 | 6631.V3.C10 | SOSIP, R6, 664 | I201C/A433C | |
| 1454 | A557 | 6644.V2.C33.sosip_d7324 | 6644.V2.C33 | SOSIP, R6, 664 | I201C/A433C | |
| 1455 | A558 | 6785.V5.C14.sosip_d7324 | 6785.V5.C14 | SOSIP, R6, 664 | I201C/A433C | |
| 1456 | A559 | 6838.V1.C35.sosip_d7324 | 6838.V1.C35 | SOSIP, R6, 664 | I201C/A433C | |
| 1457 | A560 | 89.6.DG.sosip_d7324 | 89.6.DG | SOSIP, R6, 664 | I201C/A433C | |
| 1458 | A561 | 92828.sosip_d7324 | 92828 | SOSIP, R6, 664 | I201C/A433C | |
| 1459 | A562 | 96ZM651.02.sosip_d7324 | 96ZM651.02 | SOSIP, R6, 664 | I201C/A433C | |
| 1460 | A563 | A03349M1.vrc4a.sosip_d7324 | A03349M1.vrc4a | SOSIP, R6, 664 | I201C/A433C | |
| 1461 | A564 | AC10.29.sosip_d7324 | AC10.29 | SOSIP, R6, 664 | I201C/A433C | |
| 1462 | A565 | ADA.DG.sosip_d7324 | ADA.DG | SOSIP, R6, 664 | I201C/A433C | |
| 1463 | A566 | Bal.01.sosip_d7324 | BaL.01 | SOSIP, R6, 664 | I201C/A433C | |
| 1464 | A567 | BaL.26.sosip_d7324 | BaL.26 | SOSIP, R6, 664 | I201C/A433C | |
| 1465 | A568 | BB201.1342.sosip_d7324 | BB201.B42 | SOSIP, R6, 664 | I201C/A433C | |
| 1466 | A569 | BB539.21313.sosip_d7324 | B13539.21313 | SOSIP, R6, 664 | I201C/A433C | |
| 1467 | A570 | BG1168.01.sosip_d7324 | BG1168.01 | SOSIP, R6, 664 | I201C/A433C | |
| 1468 | A571 | B1369.9A.sosip_d7324 | B1369.9A | SOSIP, R6, 664 | I201C/A433C | |
| 1469 | A572 | BL01.DG.sosip_d7324 | BL01.DG | SOSIP, R6, 664 | I201C/A433C | |
| 1470 | A573 | BR025.9.sosip_d7324 | BR025.9 | SOSIP, R6, 664 | I201C/A433C | |
| 1471 | A574 | BR07.DG.sosip_d7324 | BR07.DG | SOSIP, R6, 664 | I201C/A433C | |
| 1472 | A575 | BS208.131.sosip_d7324 | BS208.81 | SOSIP, R6, 664 | I201C/A433C | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1473 | A576 | BX08.16.sosip_d7324 | BX08.16 | SOSIP, R6, 664 | I201C/A433C | |
| 1474 | A577 | C1080.c3.sosip_d7324 | C1080.c3 | SOSIP, R6, 664 | I201C/A433C | |
| 1475 | A578 | C2101.c1.sosip_d7324 | C2101.c1 | SOSIP, R6, 664 | I201C/A433C | |
| 1476 | A579 | C3347.c11.sosip_d7324 | C3347.c11 | SOSIP, R6, 664 | I201C/A433C | |
| 1477 | A580 | C4118.09.sosip_d7324 | C4118.09 | SOSIP, R6, 664 | I201C/A433C | |
| 1478 | A581 | CAAN.A2.sosip_d7324 | CAAN.A2 | SOSIP, R6, 664 | I201C/A433C | |
| 1479 | A582 | CAP210.E8.sosip_d7324 | CAP210.E8 | SOSIP, R6, 664 | I201C/A433C | |
| 1480 | A583 | CAP244.D3.sosip_d7324 | CAP244.D3 | SOSIP, R6, 664 | I201C/A433C | |
| 1481 | A584 | CAP45.G3.sosip_d7324 | CAP45.G3 | SOSIP, R6, 664 | I201C/A433C | |
| 1482 | A585 | CH038.12.sosip_d7324 | CH038.12 | SOSIP, R6, 664 | I201C/A433C | |
| 1483 | A586 | CH070.1.sosip_d7324 | CH070.1 | SOSIP, R6, 664 | I201C/A433C | |
| 1484 | A587 | CH117.4.sosip_d7324 | CH117.4 | SOSIP, R6, 664 | I201C/A433C | |
| 1485 | A588 | CH181.12.sosip_d7324 | CH181.12 | SOSIP, R6, 664 | I201C/A433C | |
| 1486 | A589 | CNE10.sosip_d7324 | CNE10 | SOSIP, R6, 664 | I201C/A433C | |
| 1487 | A590 | CNE12.sosip_d7324 | CNE12 | SOSIP, R6, 664 | I201C/A433C | |
| 1488 | A591 | CNE14.sosip_d7324 | CNE14 | SOSIP, R6, 664 | I201C/A433C | |
| 1489 | A592 | CNE15.sosip_d7324 | CNE15 | SOSIP, R6, 664 | I201C/A433C | |
| 1490 | A593 | CNE3.sosip_d7324 | CNE3 | SOSIP, R6, 664 | I201C/A433C | |
| 1491 | A594 | CNE30.sosip_d7324 | CNE30 | SOSIP, R6, 664 | I201C/A433C | |
| 1492 | A595 | CNE31.sosip_d7324 | CNE31 | SOSIP, R6, 664 | I201C/A433C | |
| 1493 | A596 | CNE4.sosip_d7324 | CNE4 | SOSIP, R6, 664 | I201C/A433C | |
| 1494 | A597 | CNE40.sosip_d7324 | CNE40 | SOSIP, R6, 664 | I201C/A433C | |
| 1495 | A598 | CNE5.sosip_d7324 | CNE5 | SOSIP, R6, 664 | I201C/A433C | |
| 1496 | A599 | CNE53.sosip_d7324 | CNE53 | SOSIP, R6, 664 | I201C/A433C | |
| 1497 | A600 | CNE55.sosip_d7324 | CNE55 | SOSIP, R6, 664 | I201C/A433C | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1498 | A601 | CNE56.sosip_d7324 | CNE56 | SOSIP, R6, 664 | I201C/A433C | |
| 1499 | A602 | CNE57.sosip_d7324 | CNE57 | SOSIP, R6, 664 | I201C/A433C | |
| 1500 | A603 | CNE58.sosip_d7324 | CNE58 | SOSIP, R6, 664 | I201C/A433C | |
| 1501 | A604 | CNE59.sosip_d7324 | CNE59 | SOSIP, R6, 664 | I201C/A433C | |
| 1502 | A605 | CNE7.sosip_d7324 | CNE7 | SOSIP, R6, 664 | I201C/A433C | |
| 1503 | A606 | DJ263.8.sosip_d7324 | DJ263.8 | SOSIP, R6, 664 | I201C/A433C | |
| 1504 | A607 | DU123.06.sosip_d7324 | DU123.06 | SOSIP, R6, 664 | I201C/A433C | |
| 1505 | A608 | DU151.02.sosip_d7324 | DU151.02 | SOSIP, R6, 664 | I201C/A433C | |
| 1506 | A609 | DU156.12.sosip_d7324 | DU156.12 | SOSIP, R6, 664 | I201C/A433C | |
| 1507 | A610 | DU172.17.sosip_d7324 | DU172.17 | SOSIP, R6, 664 | I201C/A433C | |
| 1508 | A611 | DU422.01.sosip_d7324 | DU422.01 | SOSIP, R6, 664 | I201C/A433C | |
| 1509 | A612 | HO86.8.sosip_d7324 | HO86.8 | SOSIP, R6, 664 | I201C/A433C | |
| 1510 | A613 | HT593.1.sosip_d7324 | HT593.1 | SOSIP, R6, 664 | I201C/A433C | |
| 1511 | A614 | JRCSF.JB.sosip_d7324 | JRCSF.JB | SOSIP, R6, 664 | I201C/A433C | |
| 1512 | A615 | JRFL.JB.sosip_d7324 | JRFL.JB | SOSIP, R6, 664 | I201C/A433C | |
| 1513 | A616 | KER2008.12.sosip_d7324 | KER2008.12 | SOSIP, R6, 664 | I201C/A433C | |
| 1514 | A617 | KER2018.11.sosip_d7324 | KER2018.11 | SOSIP, R6, 664 | I201C/A433C | |
| 1515 | A618 | KNH1209.18.sosip_d7324 | KNH1209.18 | SOSIP, R6, 664 | I201C/A433C | |
| 1516 | A619 | MO2138.sosip_d7324 | MO2138 | SOSIP, R6, 664 | I201C/A433C | |
| 1517 | A620 | MB201.A1.sosip_d7324 | MB201.A1 | SOSIP, R6, 664 | I201C/A433C | |
| 1518 | A621 | MB539.2137.sosip_d7324 | MB539.287 | SOSIP, R6, 664 | I201C/A433C | |
| 1519 | A622 | MI369.A5.sosip_d7324 | MI369.A5 | SOSIP, R6, 664 | I201C/A433C | |
| 1520 | A623 | MN.3.sosip_d7324 | MN.3 | SOSIP, R6, 664 | I201C/A433C | |
| 1521 | A624 | MS208.A1.sosip_d7324 | MS208.A1 | SOSIP, R6, 664 | I201C/A433C | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1522 | A625 | MW965.26.sosip_d7324 | MW965.26 | SOSIP, R6, 664 | I201C/A433C | |
| 1523 | A626 | NKU3006.ec1.sosip_d7324 | NKU3006.ec1 | SOSIP, R6, 664 | I201C/A433C | |
| 1524 | A627 | PVO.04.sosip_d7324 | PVO.04 | SOSIP, R6, 664 | I201C/A433C | |
| 1525 | A628 | Q168.a2.sosip_d7324 | Q168.a2 | SOSIP, R6, 664 | I201C/A433C | |
| 1526 | A629 | Q23.17.sosip_d7324 | Q23.17 | SOSIP, R6, 664 | I201C/A433C | |
| 1527 | A630 | Q259.17.sosip_d7324 | Q259.17 | SOSIP, R6, 664 | I201C/A433C | |
| 1528 | A631 | Q461.e2.sosip_d7324 | Q461.e2 | SOSIP, R6, 664 | I201C/A433C | |
| 1529 | A632 | Q769.d22.sosip_d7324 | Q769.d22 | SOSIP, R6, 664 | I201C/A433C | |
| 1530 | A633 | Q769.h5.sosip_d7324 | Q769.h5 | SOSIP, R6, 664 | I201C/A433C | |
| 1531 | A634 | Q842.d12.sosip_d7324 | Q842.d12 | SOSIP, R6, 664 | I201C/A433C | |
| 1532 | A635 | QH0515.01.sosip_d7324 | QH0515.01 | SOSIP, R6, 664 | I201C/A433C | |
| 1533 | A636 | QH0692.42.sosip_d7324 | QH0692.42 | SOSIP, R6, 664 | I201C/A433C | |
| 1534 | A637 | QH209.14M.A2.sosip_d7324 | QH209.14M.A2 | SOSIP, R6, 664 | I201C/A433C | |
| 1535 | A638 | R1166.c1.sosip_d7324 | R1166.c1 | SOSIP, R6, 664 | I201C/A433C | |
| 1536 | A639 | R2184.c4.sosip_d7324 | R2184.c4 | SOSIP, R6, 664 | I201C/A433C | |
| 1537 | A640 | R3265.c6.sosip_d7324 | R3265.c6 | SOSIP, R6, 664 | I201C/A433C | |
| 1538 | A641 | REJO.67.sosip_d7324 | REJO.67 | SOSIP, R6, 664 | I201C/A433C | |
| 1539 | A642 | RHPA.7.sosip_d7324 | RHPA.7 | SOSIP, R6, 664 | I201C/A433C | |
| 1540 | A643 | RW020.2.sosip_d7324 | RW020.2 | SOSIP, R6, 664 | I201C/A433C | |
| 1541 | A644 | SC422.8.sosip_d7324 | SC422.8 | SOSIP, R6, 664 | I201C/A433C | |
| 1542 | A645 | SF162.LS.sosip_d7324 | SF162.LS | SOSIP, R6, 664 | I201C/A433C | |
| 1543 | A646 | SO18.18.sosip_d7324 | SO18.18 | SOSIP, R6, 664 | I201C/A433C | |
| 1544 | A647 | SS1196.01.sosip_d7324 | SS1196.01 | SOSIP, R6, 664 | I201C/A433C | |
| 1545 | A648 | T2504.sosip_d7324 | T2504 | SOSIP, R6, 664 | I201C/A433C | |
| 1546 | A649 | T25118.sosip_d7324 | T25118 | SOSIP, R6, 664 | I201C/A433C | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1547 | A650 | T25311.sosip_d7324 | T25311 | SOSIP, R6, 664 | I201C/A433C | |
| 1548 | A651 | T25534.sosip_d7324 | T25534 | SOSIP, R6, 664 | I201C/A433C | |
| 1549 | A652 | T25731.sosip_d7324 | T25731 | SOSIP, R6, 664 | I201C/A433C | |
| 1550 | A653 | T26660.sosip_d7324 | T26660 | SOSIP, R6, 664 | I201C/A433C | |
| 1551 | A654 | T27850.sosip_d7324 | T27850 | SOSIP, R6, 664 | I201C/A433C | |
| 1552 | A655 | T2805.sosip_d7324 | T2805 | SOSIP, R6, 664 | I201C/A433C | |
| 1553 | A656 | T337.sosip_d7324 | T337 | SOSIP, R6, 664 | I201C/A433C | |
| 1554 | A657 | TH966.8.sosip_d7324 | TH966.8 | SOSIP, R6, 664 | I201C/A433C | |
| 1555 | A658 | TH976.17.sosip_d7324 | TH976.17 | SOSIP, R6, 664 | I201C/A433C | |
| 1556 | A659 | THRO.18.sosip_d7324 | THRO.18 | SOSIP, R6, 664 | I201C/A433C | |
| 1557 | A660 | TRJO.58.sosip_d7324 | TRJO.58 | SOSIP, R6, 664 | I201C/A433C | |
| 1558 | A661 | TRO.11.sosip_d7324 | TRO.11 | SOSIP, R6, 664 | I201C/A433C | |
| 1559 | A662 | TV1.29.sosip_d7324 | TV1.29 | SOSIP, R6, 664 | I201C/A433C | |
| 1560 | A663 | TZA125.17.sosip_d7324 | TZA125.17 | SOSIP, R6, 664 | I201C/A433C | |
| 1561 | A664 | TZBD.02.sosip_d7324 | TZBD.02 | SOSIP, R6, 664 | I201C/A433C | |
| 1562 | A665 | UG021.16.sosip_d7324 | UG021.16 | SOSIP, R6, 664 | I201C/A433C | |
| 1563 | A666 | UG024.2.sosip_d7324 | UG024.2 | SOSIP, R6, 664 | I201C/A433C | |
| 1564 | A667 | UG037.8.sosip_d7324 | UG037.8 | SOSIP, R6, 664 | I201C/A433C | |
| 1565 | A668 | WITO.33.sosip_d7324 | WITO.33 | SOSIP, R6, 664 | I201C/A433C | |
| 1566 | A669 | X2088.c9.sosip_d7324 | X2088.c9 | SOSIP, R6, 664 | I201C/A433C | |
| 1567 | A670 | YU2.DG.sosip_d7324 | YU2.DG | SOSIP, R6, 664 | I201C/A433C | |
| 1568 | A671 | ZA012.29.sosip_d7324 | ZA012.29 | SOSIP, R6, 664 | I201C/A433C | |
| 1569 | A672 | ZM106.9.sosip_d7324 | ZM106.9 | SOSIP, R6, 664 | I201C/A433C | |
| 1570 | A673 | ZM109.4.sosip_d7324 | ZM109.4 | SOSIP, R6, 664 | I201C/A433C | |

-continued

| SEQ ID NO | Code | Name | Native Background | Mutations Compared to Native Background | Additional mutations | Comment |
|---|---|---|---|---|---|---|
| 1571 | A674 | ZM135.10a.sosip_d7324 | ZM135.10a | SOSIP, R6, 664 | I201C/A433C | |
| 1572 | A675 | ZM176.66.sosip_d7324 | ZM176.66 | SOSIP, R6, 664 | I201C/A433C | |
| 1573 | A676 | ZM197.7.sosip_d7324 | ZM197.7 | SOSIP, R6, 664 | I201C/A433C | |
| 1574 | A677 | ZM214

| 1 SEQ ID NO | 2 Code | 3 Name | 4 Native Background | 5 Mutations Compared to Native Background | 6 Additional mutations | 7 Comment |
|---|---|---|---|---|---|---|
| 1589 | A692 | JRFLgp140.6R.SOSIP.664.E168K, BG505 gp41 chim, I201C-A433C, V127C, D167C | JRFLgp140/BG505 chimera | SOSIP, R6, 664 | E168K, I201C-A433C, V127C, D167C | Interprotomer DS |
| 1590 | A693 | JRFLgp140.6R.SOSIP.664.E168K, T128C, D167C | JRFLgp140/BG505 chimera | SOSIP, R6, 664 | E168K, T128C, D167C | Interprotomer DS |
| 1591 | A694 | JRFLgp140.6R.SOSIP.664.E168K, BG505 gp41 chim, I201C-A433C, V127C, D167C | JRFLgp140/BG505 chimera | SOSIP, R6, 664 | E168K, I201C-A433C, V127C, D167C | Interprotomer DS |
| 1592 | A695 | JRFLgp140.6R.SOSIP.664.E168K, BG505 gp41 chim, I201C-A433C, I165C, C196S | JRFLgp140/BG505 chimera | SOSIP, R6, 664 | E168K, I201C-A433C, I165C, C196S | Interprotomer DS |
| 1593 | A696 | JRFLgp140.6R.SOSIP.664.E168K, BG505 gp41 chim, I201C-A433C, I165C, C196F | JRFLgp140/BG505 chimera | SOSIP, R6, 664 | E168K, I201C-A433C, I165C, C196F | Interprotomer DS |
| 1594 | A697 | JRFLgp140.6R.SOSIP.664.E168K, BG505 gp41 chim, I201C-A433C, I165C, C196L | JRFLgp140/BG505 chimera | SOSIP, R6, 664 | E168K, I201C-A433C, I165C, C196L | Interprotomer DS |
| 1595 | A698 | JRFLgp140.6R.SOSIP.664.E168K, BG505 gp41 chim, I201C-A433C, I165C, C196S | JRFLgp140/BG505 chimera | SOSIP, R6, 664 | E168K, I165C, C196S | Interprotomer DS |
| 1596 | A699 | JRFLgp140.6R.SOSIP.664.E168K, BG505 gp41 chim, I201C-A433C, I165C, C196F | JRFLgp140/BG505 chimera | SOSIP, R6, 664 | E168K, I165C, C196F | Interprotomer DS |
| 1597 | A700 | JRFLgp140.6R.SOSIP.664.E168K, BG505 gp41 chim, I201C-A433C, I165C, C196L | JRFLgp140/BG505 chimera | SOSIP, R6, 664 | E168K, I165C, C196L | Interprotomer DS |
| 1598 | A701 | JRFLgp140.6R.SOSIP.664.E168K, BG505 gp41 chim, I201C-A433C, R304C/R440C | JRFLgp140/BG505 chimera | SOSIP, R6, 664 | E168K, I201C-A433C, R304C/R440C | DDS |
| 1599 | A702 | JRFLgp140.6R.SOSIP.664.E168K, BG505 gp41 chim, I201C-A433C, A174C/T319C | JRFLgp140/BG505 chimera | SOSIP, R6, 664 | E168K, I201C-A433C, A174C/T319C | DDS |
| 1600 | A703 | JRFLgp140.6R.SOSIP.664.E168K, BG505 gp41 chim, I201C-A433C, S164C/H308C | JRFLgp140/BG505 chimera | SOSIP, R6, 664 | E168K, I201C-A433C, S164C/H308C | DDS |
| 1601 | A704 | JRFLgp140.6R.SOSIP.664.E168K, BG505 gp41 chim, I201C-A433C, S110C/L556C | JRFLgp140/BG505 chimera | SOSIP, R6, 664 | E168K, I201C-A433C, S110C/L556C | Interprotomer DS |
| 1602 | A705 | JRFLgp140.6R.SOSIP.664.E168K, S110C/L556C | JRFLgp140/BG505 chimera | SOSIP, R6, 664 | E168K, S110C/L556C | Interprotomer DS |
| 1603 | A706 | JRFLgp140.6R.SOSIP.664.E168K, BG505 gp41 chim, I201C-A433C, A558C/D113C | JRFLgp140/BG505 chimera | SOSIP, R6, 664 | E168K, I201C-A433C, A558C/D113C | Interprotomer DS |
| 1604 | A707 | JRFLgp140.6R.SOSIP.664.E168K, A558C/D113C | JRFLgp140/BG505 chimera | SOSIP, R6, 664 | E168K, A558C/D113C | Interprotomer DS |

| 1 SEQ ID NO | 2 Code | 3 Name | 4 Native Background | 5 Mutations Compared to Native Background | 6 Additional mutations | 7 Comment |
|---|---|---|---|---|---|---|
| 1605 | A708 | JRFLgp140.6R.SOSIP.664.E168K,E561W | JRFLgp140/BG505 chimera | SOSIP, R6, 664 | E168K,E561W | Cav |
| 1606 | A709 | JRFLgp140.6R.SOSIP.664.E168K,E561F | JRFLgp140/BG505 chimera | SOSIP, R6, 664 | E168K,E561F | Cav |
| 1607 | A710 | JRFLgp140.6R.SOSIP.664.E168K,E561W/K121F | JRFLgp140/BG505 chimera | SOSIP, R6, 664 | E168K,E561W/K121F | Cav |
| 1608 | A711 | JRFLgp140.6R.SOSIP.664.E168K,E561F/K121F | JRFLgp140/BG505 chimera | SOSIP, R6, 664 | E168K,E561F/K121F | Cav |
| 1609 | A712 | JRFLgp140.6R.SOSIP.664.E168K,E561W/K121W | JRFLgp140/BG505 chimera | SOSIP, R6, 664 | E168K,E561W/K121W | Cav |
| 1610 | A713 | JRFLgp140.6R.SOSIP.664.E168K,E561F/K121W | JRFLgp140/BG505 chimera | SOSIP, R6, 664 | E168K,E561F/K121W | Cav |
| 1611 | A714 | BG505gp140.6R.SOSIP.664.T332N.D7325 Q315C | BG505 | SOSIP, R6, 664 | T332N.D7325 Q315C | |
| 1612 | A715 | BG505gp140.6R.SOSIP.664.T332N.D7324 V120C | BG505 | SOSIP, R6, 664 | T332N.D7324 V120C | |
| 1613 | A716 | JRFLgp140.6R.SOSIP.664.E168K_Q315C | JRFL | SOSIP, R6, 664 | E168K_Q315C | |
| 1614 | A717 | JRFLgp140.6R.SOSIP.664.E168K_V120C | JRFL | SOSIP, R6, 664 | E168K_V120C | |
| 1615 | A718 | JRFLgp140.6R.SOSIP.664.E168K | JRFL | SOSIP, R6, 664 | E168K | |
| 1616 | A719 | JRFLgp140.6R.SOSIP.664.E168K_I201C/A433C | JRFL | SOSIP, R6, 664 | E168K_I201C/A433C | DS |
| 1617 | A720 | JRFLgp140.6R.SOSIP.664.E168K_A433P | JRFL | SOSIP, R6, 664 | E168K_A433P | stability |
| 1618 | A721 | JRFLgp140.6R.SOSIP.664.E168K_Q432P | JRFL | SOSIP, R6, 664 | E168K_Q432P | stability |
| 1619 | A722 | JRFLgp140.6R.SOSIP.664.E168K_S174C/A319C | JRFL | SOSIP, R6, 664 | E168K_S174C/A319C | |
| 1620 | A723 | JRFLgp140.6R.SOSIP.664.E168K_N195C/A433C | JRFL | SOSIP, R6, 664 | E168K_N195C/A433C | |
| 1621 | A724 | JRFLgp140.6R.SOSIP.664.E168K_S199C/A433C | JRFL | SOSIP, R6, 664 | E168K_S199C/A433C | |
| 1622 | A725 | JRFLgp140.6R.SOSIP.664.E168K_R304C/Q440C | JRFL | SOSIP, R6, 664 | E168K_R304C/Q440C | |

| 1 SEQ ID NO | 2 Code | 3 Name | 4 Native Background | 5 Mutations Compared to Native Background | 6 Additional mutations | 7 Comment |
|---|---|---|---|---|---|---|
| 1623 | A726 | JRFLgp140.6R.SOSIP.664.E168K_F223W | JRFL | SOSIP, R6, 664 | E168K_F223W | Cav |
| 1624 | A727 | JRFLgp140.6R.SOSIP.664.E168K_G473Y | JRFL | SOSIP, R6, 664 | E168K_G473Y | Cav |
| 1625 | A728 | JRFLgp140.6R.SOSIP.664.E168K_G431P | JRFL | SOSIP, R6, 664 | E168K_G431P | stability |
| 1626 | A729 | JRFLgp140.6R.SOSIP.664.E168K_N425C_A433C | JRFL | SOSIP, R6, 664 | E168K_N425C_A433C | |
| 1627 | A730 | JRFLgp140.6R.SOSIP.664.E168K_V120C_Q315C | JRFL | SOSIP, R6, 664 | E168K_V120C_Q315C | |
| 1628 | A731 | JRFLgp140.6R.SOSIP.664.E168K_Q203C_L122C | JRFL | SOSIP, R6, 664 | E168K_Q203C_L122C | |
| 1629 | A732 | JRFLgp140.6R.SOSIP.664.E168K_I201C/A433C/R304C/Q440C | JRFL | SOSIP, R6, 664 | E168K_I201C/A433C/R304C/Q440C | |
| 1630 | A733 | JRFLgp140.6R.SOSIP.664.E168K_R304C/R440C | JRFL | SOSIP, R6, 664 | E168K_R304C/R440C | |
| 1631 | A734 | JRFLgp140.6R.SOSIP.664.E168K_Q203C/F317C | JRFL | SOSIP, R6, 664 | E168K_Q203C/F317C | |
| 1632 | A735 | JRFLgp140.6R.SOSIP.664.E168K_L122C/F317C | JRFL | SOSIP, R6, 664 | E168K_L122C/F317C | |
| 1633 | A736 | JRFLgp140.6R.SOSIP.664.E168K_P437C/Y318C | JRFL | SOSIP, R6, 664 | E168K_P437C/Y318C | |
| 1634 | A737 | JRFLgp140.6R.SOSIP.664.E168K_E172C/I307C | JRFL | SOSIP, R6, 664 | E168K_E172C/I307C | |
| 1635 | A738 | JRFLgp140.6R.SOSIP.664.E168K_P206C/Y318C | JRFL | SOSIP, R6, 664 | E168K_P206C/Y318C | |
| 1636 | A739 | JRFLgp140.6R.SOSIP.664.E168K_A174C/T319C | JRFL | SOSIP, R6, 664 | E168K_A174C/T319C | |
| 1637 | A740 | JRFLgp140.6R.SOSIP.664.E168K_S164C/H308C | JRFL | SOSIP, R6, 664 | E168K_S164C/H308C | |
| 1638 | A741 | JRFLgp140.6R.SOSIP.664.E168K_T320C/L175C | JRFL | SOSIP, R6, 664 | E168K_T320C/L175C | |
| 1639 | A742 | JRFLgp140.6R.SOSIP.664.E168K_T320C/P438C | JRFL | SOSIP, R6, 664 | E168K_T320C/P438C | |
| 1640 | A743 | JRFLgp140.6R.SOS.664.E168K | JRFL | 6R.SOS.664 | E168K | stability |

-continued

| SEQ ID NO | Code | Name | Native Background | Mutations Compared to Native Background | Additional mutations | Comment |
|---|---|---|---|---|---|---|
| 1641 | A744 | JRFLgp140.6R.IP.664.E168K | JRFL | 6R.IP.664 | E168K | stability |
| 1642 | A745 | JRFLgp140.6R.664.E168K | JRFL | 6R.664 | E168K | stability |
| 1643 | B192 | *703010505.TF-chim-sc d7324, R6, 664, I201C/A433C<br><br>AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKR<br>EKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRP<br>NNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVG<br>RAMYAPPIAGNITCISNITGLLLTRDGGKNNTETFRPGGGNMKDNWRSELIYKYKVVKIEPLGVAPTRCKRRVVGgsgsggsggsAVGIGAVFLGFLGAAGSTMGAASMTLTVQARNLLSGIVQQQ<br>SNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | 703010505.TF/BG505 chimera | SOSIP, sc15ln, 664 | I201C/A433C | |
| 1644 | B193 | 703010505.TF-chim-sc d7324 tad, sc15ln, 664, I201C/A433C/E47D/K49E/V65K/E106T/E429R/R432Q/E500R | 703010505.TF/BG505 chimera | SOSIP, sc15ln, 664 | I201C/A433C/E47D/K49E/V65K/E106T/E429R/R432Q/E500R | single chain 15 amino acid linker, trimer association domain mutations |
| 1645 | B194 | bg505.sosip_c15ln.DS_gly3 | BG505 | SOSIP; 664, 201C, 433C | 278A, 365A, 464A | Increase CD4-binding site accessibility by removing glycans around it |
| 1646 | B195 | bg505.sosip_c15ln.DS_gly4 | BG505 | SOSIP; 664, 201C, 433C | S199A, 278A, 365A, 464A | Same as Seq_1645 |
| 1647 | B196 | bg505.sosip_c15ln.DS_gly5 | BG505 | SOSIP; 664, 201C, 433C | S199A, 278A, 365A, 388A, 464A | Same as Seq_1645 |
| 1648 | B197 | ZM55.28a-chim-sc_DS_gly3 | ZM55/BG505 chimera | SOSIP; 664, 201C, 433C | Seq_0534 linker between 508-511, BG505 Platform, BG505 Res. Set B, remainder = ZM55.28a, 278A, 463A, 467A | Same as Seq_1645 |
| 1649 | B198 | ZM55.28a-chim-sc_DS_gly4 | ZM55/BG505 chimera | SOSIP; 664, 201C, 433C | Seq_0534 linker between 508-511, BG505 Platform, BG505 Res. Set B, remainder = ZM55.28a, S199A, 278A, 463A, 467A | Same as Seq_1645 |
| 1650 | B199 | ZM55.28a-chim-sc_DS_gly5 | ZM55/BG505 chimera | SOSIP; 664, 201C, 433C | Seq_0534 linker between 508-511, BG505 Platform, BG505 Res. Set B, remainder = ZM55.28a, S199A, 278A, 388A, 463A, 467A | Same as Seq_1645 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1651 | D011 | BG505sosip_ig_I201C/A433C.STOP-gly3 | BG505 | SOSIP, R6, 664, 201C/433C | 278A, 365A, 464A | Same as Seq_1645 |
| 1652 | D012 | BG505sosip_ig_I201C/A433C.STOP-gly4 | BG505 | SOSIP, R6, 664, 201C/433C | S199A, 278A, 365A, 464A | Same as Seq_1645 |
| 1653 | D013 | BG505sosip_ig_I201C/A433C.STOP-gly5 | BG505 | SOSIP, R6, 664, 201C/433C | S199A, 278A, 365A, 388A, 464A | Same as Seq_1645 |
| 1654 | D014 | CH505SOSIP_DS_degly3 | CH505 | SOSIP, R6, 664, 201C/433C | 278A, 463A | Same as Seq_1645 |
| 1655 | D015 | CH505SOSIP_DS_degly4 | CH505 | SOSIP, R6, 664, 201C/433C | 199A, 278A, 463A | Same as Seq_1645 |
| 1656 | D016 | CH505SOSIP_DS_degly5 | CH505 | SOSIP, R6, 664, 201C/433C | 199A, 278A, 388A, 463A | Same as Seq_1645 |
| 1657 | D017 | ZM55.28a-chim_DS_gly3 | ZM55/BG505 chimera | SOSIP, R6, 664, 201C/433C | BG505 Platform, BG505 Res. Set B, remainder = ZM55.28a, 278A, 463A, 467A | Same as Seq_1645 |
| 1658 | D018 | ZM55.28a-chim_DS_gly4 | ZM55/BG505 chimera | SOSIP, R6, 664, 201C/433C | BG505 Platform, BG505 Res. Set B, remainder = ZM55.28a, S199A, 278A, 463A, 467A | Same as Seq_1645 |
| 1659 | D019 | ZM55.28a-chim_DS_gly5 | ZM55/BG505 chimera | SOSIP, R6, 664, 201C/433C | BG505 Platform, BG505 Res. Set B, remainder = ZM55.28a, S199A, 278A, 388A, 463A, 467A | Same as Seq_1645 |
| 1660 | D020 | ZM106.9.sosip_DS_gly3 | Zm1096.9 | SOSIP, R6, 664, 201C/433C | 278A, 466A | Same as Seq_1645 |
| 1661 | D021 | ZM106.9.sosip_DS_gly4 | Zm1096.9 | SOSIP, R6, 664, 201C/433C | S199A, 278A, 466A | Same as Seq_1645 |
| 1662 | D022 | ZM106.9.sosip_DS_gly5 | Zm1096.9 | SOSIP, R6, 664, 201C/433C | S199A, 278A, 388A, 466A | Same as Seq_1645 |
| 1663 | D023 | CH038.12-chim_DS_gly3 | CH038/BG505 chimera | SOSIP, R6, 664, 201C/433C | BG505 Platform, BG505 Res. Set B, remainder = CH038, 278A, 464A, 467A | Same as Seq_1645 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1664 | D024 | CH038.12-chim_DS_gly4 | CH038/BG505 chimera | SOSIP, R6, 664, 201C/433C | BG505 Platform, BG505 Res. Set B, remainder = CH038, 199A, 278A, 464A, 467A | Same as Seq_1645 |
| 1665 | D025 | CH038.12-chim_DS_gly5 | CH038/BG505 chimera | SOSIP, R6, 664, 201C/433C | BG505 Platform, BG505 Res. Set B, remainder = CH038, 199A, 278A, 388A, 464A, 467A | Same as Seq_1645 |
| 1666 | D026 | ZM106.9-chim_DS_gly3 | ZM106/BG505 chimera | SOSIP, R6, 664, 201C/433C | BG505 Platform, BG505 Res. Set B, remainder = ZM106.9, 278A, 466A | Same as Seq_1645 |
| 1667 | D027 | ZM106.9-chim_DS_gly4 | ZM106/BG505 chimera | SOSIP, R6, 664, 201C/433C | BG505 Platform, BG505 Res. Set B, remainder = ZM106.9, S199A, 278A, 466A | Same as Seq_1645 |
| 1668 | D028 | ZM106.9-chim_DS_gly5 | ZM106/BG505 chimera | SOSIP, R6, 664, 201C/433C | BG505 Platform, BG505 Res. Set B, remainder = ZM106.9, S199A, 278A, 388A, 466A | Same as Seq_1645 |
| 1669 | D029 | 16055-2.3-chim_DS_gly3 | 10655/BG505 chimera | SOSIP, R6, 664, 201C/433C | BG505 Platform, BG505 Res. Set B, remainder = 10655, 278A, 465A | Same as Seq_1645 |
| 1670 | D030 | 16055-2.3-chim_DS_gly4 | 10655/BG505 chimera | SOSIP, R6, 664, 201C/433C | BG505 Platform, BG505 Res. Set B, remainder = 10655, S199A, 278A, 465A | Same as Seq_1645 |
| 1671 | D031 | 16055-2.3-chim_DS_gly5 | 10655/BG505 chimera | SOSIP, R6, 664, 201C/433C | BG505 Platform, BG505 Res. Set B, remainder = 10655, S199A, 278A, 388A, 465A | Same as Seq_1645 |
| 1672 | D032 | 45_01dG5_bg505-NCgp120 + gp41.SOSIP_DS_gly3 | 45-01dG5/BG505 chimera | SOSIP, R6, 664, 201C/433C | BG505 Platform, BG505 Res. Set B, remainder = 45_01dG5, 364A | Same as Seq_1645 |
| 1673 | D033 | 45_01dG5_bg505-NCgp120 + gp41.SOSIP_DS_gly4 | 45-01dG5/BG505 chimera | SOSIP, R6, 664, 201C/433C | BG505 Platform, BG505 Res. Set B, remainder = 45_01dG5, S199A, 364A | Same as Seq_1645 |
| 1674 | D034 | 426c_degly3DS | 426c | SOSIP, R6, 664, 201C/433C | 278A, 462A | Same as Seq_1645 |

| SEQ ID NO | Code | Name | Native Background | Mutations Compared to Native Background | Additional mutations | Comment |
|---|---|---|---|---|---|---|
| 1675 | D035 | 426c_degly4DS | 426c | SOSIP, R6, 664, 201C/433C | S199A, 278A, 462A | Same as Seq_1645 |
| 1676 | H385 | *426c-v1v2-WITO-degly4-S199A/I201C/A433C/N276D/N460D/N463D/R504N/V506T/L661N/L663T | 426c/WITO-V1v2/BG505 chimera | SOSIP, R6, 664, S199A/I201C/A433C/N276D/N460D/N463D/R504N/V506T/L661N/L663T | | BG505 chimera, V1V2 chimera, glycan shielding at residues 504, 661 |
| | | AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTTTVIRDKIQKEYALFYKLDIVPIEGKNTNTGYRLLINCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRnvtGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRLSEIWDNMTWLQWDKEISNYTQYIGLLEESQNQQEKNEQDLnAtD | | | | |
| 1677 | H386 | *426c-v1v2-WITO-degly3-I201C/A433C/N276D/N460D/N463D/R504N/V506T/L661N/L663T | 426c/WITO-V1v2/BG505 chimera | SOSIP, R6, 664, I201C/A433C/N276D/N460D/N463D/R504N/V506T/L661N/L663T | | BG505 chimera, V1V2 chimera, glycan shielding at residues 504, 662 |
| | | AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTTTVIRDKIQKEYALFYKLDIVPIEGKNTNTGYRLLINCNTsTCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRnvtGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRLSEIWDNMTWLQWDKEISNYTQYIGLLEESQNQQEKNEQDLnAtD | | | | |
| 1678 | H387 | *426c-v1v2-ZM233-S199A/I201C/A433C/N276D/N460D/N463D/R504N/V506T/L661N/L663T | 426c/ZM233-V1v2/BG505 chimera | SOSIP, R6, 664, S199A/I201C/A433C/N276D/N460D/N463D/R504N/V506T/L661N/L663T | | BG505 chimera, V1V2 chimera, glycan shielding at residues 504, 663 |
| | | AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLDCSTYNNTHNISKEMKICSFNMTTELRDKKRKVNVLFYKLDLVPLTNSSNTTNYRLISCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRnvtGRRRRRRAVGIGAVFLGFLGAAGSTMGAASMTLTVQARNLLSGIVQQQSNLLRAPEAQQHLLKLTVWGI | | | | |
| 1679 | H388 | *426c-v1v2-ZM233-degly3-I201C/A433C/N276D/N460D/N463D/R504N/V506T/L661N/L663T | 426c/ZM233-V1v2/BG505 chimera | SOSIP, R6, 664, I201C/A433C/N276D/N460D/N463D/R504N/V506T/L661N/L663T | | BG505 chimera, V1V2 chimera, glycan shielding at residues 504, 664 |
| | | AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLDCSTYNNTHNISKEMKICSFNMTTELRDKKRKVNVLFYKLDLVPLTNSSNTTNYRLISCNTsTCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRnvtGRRRRRRAVGIGAVFLGFLGAAGSTMGAASMTLTVQARNLLSGIVQQQSNLLRAPEAQQHLLKLTVWGI | | | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1680 | H389 | *d45-01dG5chim-v1v2-WITO-I201C/A433C/R504N/V506T/L661N/L663T AENLWVTVYYGVPVWKEATATLFCASDAKAYETEVHNVWATHACVPTDPNPQEVVLENVTENFNMWKNNMVEQMHEDIISLWDQSLKPCVKLTPLCVTLHCTNVTISSTNGSTANVTMREEMKCSFNTT TVIRDK -continued

| 1 SEQ ID NO | 2 Code | 3 Name | 4 Native Background | 5 Mutations Compared to Native Background | 6 Additional mutations | 7 Comment |
|---|---|---|---|---|---|---|
| 1684 | H393 | *d45-01dG5chim-v1v2-ZM233-degly3-I201C/S364A/A433C/R504N/V506T/L661N/L663T | donor45-01dG5/ZM233-v1v2/BG505 chimera | SOSIP, R6, 664, I201C/S364A/A433C/R504N/V506T/L661N/L663T | | BG505 chimera, V1V2 chimera, glycan shielding at residues 504, 669 |
| | | AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKR KVNVLFYKLDLVPLTNSSNTTNYRLISCNTsVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTR PNNNTRKSIPIGPGRAFYTTGAIIGDIRQAHCNISKAKWENTLKQIARKLREHFKNETIAFNQaSGGDPEIVMHSFNCGGEFFYCNSTQLFNSTWTWNDTEVVNNTEKNINITLPCRIKQIINMWQEVGK CMYAPPIKGQIRCSSNITGLLLTRDGGSSTNGTETFRPGGGDMRDNWRSELYKYKVVKIEPLGVAPTRCKRnVtGRRRRRRAVGIGAVFLGFLGAAGSTMGAASMTLTVQARNLLSGIVQQQSNLLRAP EAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLnAtD | | | | | |
| 1685 | H394 | *d45-01dG5chim-v1v2-ZM233-degly4-S199A/201C/S364A/A433C/R504N/V506T/L661N/L663T | donor45-01dG5/ZM233-v1v2/BG505 chimera | SOSIP, R6, 664, S199A/201C/S364A/A433C/R504N/V506T/L661N/L663T | | BG505 chimera, V1V2 chimera, glycan shielding at residues 504, 670 |
| | | AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKR KVNVLFYKLDLVPLTNSSNTTNYRLISCNTaVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTR PNNNTRKSIPIGPGRAFYTTGAIIGDIRQAHCNISKAKWENTLKQIARKLREHFKNETIAFNQaSGGDPEIVMHSFNCGGEFFYCNSTQLFNSTWTWNDTEVVNNTEKNINITLPCRIKQIINMWQEVGK CMYAPPIKGQIRCSSNITGLLLTRDGGSSTNGTETFRPGGGDMRDNWRSELYKYKVVKIEPLGVAPTRCKRnVtGRRRRRRAVGIGAVFLGFLGAAGSTMGAASMTLTVQARNLLSGIVQQQSNLLRAP EAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLnAtD | | | | | |
| 1686 | H395 | *426c-v1v2-WITO-degly4-S199A/I201C/A433C/N276D/N460D/N463D | 426c/WITO-V1v2/BG505 chimera | SOSIP, R6, 664, S199A/I201C/A433C/N276D/N460D/N463D | | BG505 chimera, V1V2 chimera, glycan shielding at residues 504, 661 |
| | | AENLWVTVYYGVPVWKEAKTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTT TVIRDKIQKEYALFYKLDIVPIEGKNTNTGYRLINCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNK TFGKEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAP PIKGNITCKSDITGLLLLRDGGNTANNAEIFRPGGGDMRDNWRSELYKYKVVKIEPLGVAPTRCKRvVGRRRRRAVGIGAVFLGFLGAAGSTMGAASMTLTVQARNLLSGIVQQQSNLLRAPEAQQHLL KLTVWGIKQLQARVLAVERYLRDQQLLGIWGCSGKLICCTNVPWNSSWSNRNLSEIWDNMTWLQWDKEISNYTQIYGLLEESQNQQEKNEQDLLALD | | | | | |
| 1687 | H396 | *426c-v1v2-WITO-degly3-I201C/A433C/N276D/N460D/N463D | 426c/WITO-V1v2/BG505 chimera | SOSIP, R6, 664, I201C/A433C/N276D/N460D/N463D | | BG505 chimera, V1V2 chimera, glycan shielding at residues 504, 662 |
| | | AENLWVTVYYGVPVWKEAKTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTT TVIRDKIQKEYALFYKLDIVPIEGKNTNTGYRLINCNTsTCTQACPKVTFDPIPIHYCAPAGYAILKCNNKTFNGKGPCNNVSTVQCTHGIKPVVSTQLLLNGSLAEEEIVIRSKNLADNAKIIIVQLNK SVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAP PIKGNITCKSDITGLLLLRDGGNTANNAEIFRPGGGDMRDNWRSELYKYKVVKIEPLGVAPTRCKRvVGRRRRRAVGIGAVFLGFLGAAGSTMGAASMTLTVQARNLLSGIVQQQSNLLRAPEAQQHLL KLTVWGIKQLQARVLAVERYLRDQQLLGIWGCSGKLICCTNVPWNSSWSNRNLSEIWDNMTWLQWDKEISNYTQIYGLLEESQNQQEKNEQDLLALD | | | | | |

-continued

| SEQ ID NO | Code | Name | Native Background | Mutations Compared to Native Background | Additional mutations | Comment |
|---|---|---|---|---|---|---|
| 1688 | H397 | *426c-v1v2-ZM233-degly4-S199A/I201C/A433C/N276D/N460D/N463D | 426c/ZM233-V1V2/BG505 chimera | SOSIP, R6, 664, S199A/I201C/A433C/N276D/N460D/N463D | | BG505 chimera, V1V2 chimera, glycan shielding at residues 504, 663 |

AENLWVTVYYGVPVWKEAKTLFCASDAKAYEKEVHNVWATHACVTDPNPQEVVLENVTENFNMWKNDMVDQMQEDVISIWDQSLKPCVKLTPLCVTLDCSTYNNTHNISKEMKICSFNMTTELRDKKR KVNVLFYKLDLVPLTNSSNTNYRLISCNTATCTQACPKVTFDPIPIHYCAPAGYAILKCNNKTFNGKGPCNNVSTVQCTHGIRPVVSTQLLNGSLAEEEIVIRSKNLADNAKIIIVQLNKSVEIVCTR PNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITC KSDITGLLLLRDGGNTANNAEIFRPGGGDMRDNWRSELYKYKVVKIEPLGVAPTRCKRRvVGRRRRRAVGIGAVFLGFLGAAGSTMGAASMTLTVQARNLLSGIVQQQSNLLRAPEAQQHLLKLTVWGI KQLQARVLAVERYLRDQQLLGIWGCSGKLICCTNVPWNSSWSNRNLSEIWDNMTWLQWDKEISNYTQIIYGLLEESQNQQEKNEQDLLALD

| 1689 | H398 | *426c-v1v2-ZM233-degly3-I201C/A433C/N276D/N460D/N463D | 426c/ZM233-V1V2/BG505 chimera | SOSIP, R6, 664, I201C/A433C/N276D/N460D/N463D | | BG505 chimera, V1V2 chimera, glycan shielding at residues 504, 664 |

AENLWVTVYYGVPVWKEAKTLFCASDAKAYEKEVHNVWATHACVTDPNPQEVVLENVTENFNMWKNDMVDQMQEDVISIWDQSLKPCVKLTPLCVTLDCSTYNNTHNISKEMKICSFNMTTELRDKKR KVNVLFYKLDLVPLTNSSNTNYRLISCNTsTCTQACPKVTFDPIPIHYCAPAGYAILKCNNKTFNGKGPCNNVSTVQCTHGIRPVVSTQLLNGSLAEEEIVIRSKNLADNAKIIIVQLNKSVEIVCTR PNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITC KSDITGLLLLRDGGNTANNAEIFRPGGGDMRDNWRSELYKYKVVKIEPLGVAPTRCKRRvVGRRRRRAVGIGAVFLGFLGAAGSTMGAASMTLTVQARNLLSGIVQQQSNLLRAPEAQQHLLKLTVWGI KQLQARVLAVERYLRDQQLLGIWGCSGKLICCTNVPWNSSWSNRNLSEIWDNMTWLQWDKEISNYTQIIYGLLEESQNQQEKNEQDLLALD

| 1690 | H399 | *q45-01dG5chim-v1v2-WITO-I201C/A433C | d0n0r45-01dG5/WITO-V1v2/BG505 chimera | SOSIP, R6, 664, I201C/A433C | | BG505 chimera, V1V2 chimera, glycan shielding at residues 504, 665 |

AENLWVTVYYGVPVWKEATATLFCASDAKAYETEVHNVWATHACVTDPNPQEVVLENVTENFNMWKNNMVEQMHEDIISLWDQSLKPCVKLTPLCVTLHCTNVTISSTNGSTANVTMREEMKNCSFNTT TVIRDKIQKEYALFYKLDIVPIEGKNTNTGYRLINCNTsVCTQACPKISFEPIPIHYCAPAGFAILKCNDKKFNGTGPCTNVSTVQCTHGIRPVVSTQLLNGSLAEEEIVIRSENIKDNAKIIIVQLNE TVEINCTRPNNNTRKSIPIGPGRAFYTTGAIIGDIRQAHCNISKAKWENTLKQIARKLREHFKNETIAFNQssGGDPEIVMHSFNCGGEFFYCNSTQLFNSTWTWNDTEVNNTEKNINITLPCRIKQII NMWQEVGKCMYAPPIKGQIRCSSNITGLLLTRDGGSSTNGITETFRPGGGDMRDNWRSELYKYKVVKIEPLGVAPTRCKRRVVGRRRRRRAVGIGAVFLGFLGAAGSTMGAASMTLTVQARNLLSGIVQQ QSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

| 1691 | H400 | *q45-01dG5chim-v1v2-WITO-degly3-I201C/S364A/A433C | d0n0r45-01dG5/WITO-V1v2/BG505 chimera | SOSIP, R6, 664, I201C/S364A/A433C | | BG505 chimera, V1V2 chimera, glycan shielding at residues 504, 666 |

AENLWVTVYYGVPVWKEATATLFCASDAKAYETEVHNVWATHACVTDPNPQEVVLENVTENFNMWKNNMVEQMHEDIISLWDQSLKPCVKLTPLCVTLHCTNVTISSTNGSTANVTMREEMKNCSFNTT TVIRDKIQKEYALFYKLDIVPIEGKNTNTGYRLINCNTsVCTQACPKISFEPIPIHYCAPAGFAILKCNDKKFNGTGPCTNVSTVQCTHGIRPVVSTQLLNGSLAEEEIVIRSENIKDNAKIIIVQLNE TVEINCTRPNNNTRKSIPIGPGRAFYTTGAIIGDIRQAHCNISKAKWENTLKQIARKLREHFKNETIAFNQaSGGDPEIVMHSFNCGGEFFYCNSTQLFNSTWTWNDTEVNNTEKNINITLPCRIKQII NMWQEVGKCMYAPPIKGQIRCSSNITGLLLTRDGGSSTNGITETFRPGGGDMRDNWRSELYKYKVVKIEPLGVAPTRCKRRVVGRRRRRAVGIGAVFLGFLGAAGSTMGAASMTLTVQARNLLSGIVQQ QSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1692 | H401 | *d45-01dG5chim-v1v2-WITO-degly4-S199A/I201C/S364A | d0n0r45-01dG5/WITO-V1v2/BG505 chimera | SOSIP, R6, 664, S199A/I201C/S364A/A433C | | BG505 chimera, V1V2 chimera, glycan shielding at residues 504, 667 |
| | AENLWVTVYYGVPVWKEATATLFCASDAKAYETEVHNVWATHACVPTDPNPQEVVLENVTENFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTaVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQaSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | | |
| 1693 | H402 | *d45-01dG5chim-v1v2-ZM233-I201C/A433C | d0n0r45-01dG5/ZM233-V1v2/BG505 chimera | SOSIP, R6, 664, I201C/A433C | | BG505 chimera, V1V2 chimera, glycan shielding at residues 504, 668 |
| | AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTsVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQsSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | | |
| 1694 | H403 | *d45-01dG5chim-v1v2-ZM233-degly3-I201C/S364A/A433C | d0n0r45-01dG5/ZM233-V1v2/BG505 chimera | SOSIP, R6, 664, I201C/S364A/A433C | | BG505 chimera, V1V2 chimera, glycan shielding at residues 504, 669 |
| | AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTsVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQaSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | | |

-continued

| SEQ ID NO | Code | Name | Native Background | Mutations Compared to Native Background | Additional mutations | Comment |
|---|---|---|---|---|---|---|
| 1695 | H404 | *445-01dG5chim-v1v2-ZM233-degly4-S199A/201C/S364A/A433C | donor45-01dG5/ZM233-V1v2/BG505 chimera | SOSIP, R6, 664, S199A/201C/S364A/A433C | | BG505 chimera, V1V2 chimera, glycan shielding at residues 504, 670 |

AENLWTVYYGVPVWKEATATLFCASDAKAYETEVHNVWATHACVPTDPNFPQEVVLENVTENFNMWKNNMVEQMHEDIISLWDQSLKPCVKLTPLCVTLDCSTYNNTHNISKEMKICSFNMTTELRDKKR
KVNVLFYKLDLVPLTNSSNTNYRLISCNTAVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTR
PNNNTRKSIPIGPGRAFYTTGAIIGDIRQAHCNISKAKWENTLKQIARKLREHFKNETIAFNQaSGGDPEIVMHSFNCGGEFFYCNSTQLFNSTWTWNDTEVVNNTEKNINITLPCRIKQIINMWQEVGK
CMYAPPIKGQIRCSSNITGLLLTRDGGSSTNGTTETFRPGGGDMRDNWRSELYKYKVKIEPLGVAPTRCKRRVVGRRRRRAVGIGAVFLGFLGAAGSTMGAASMTLTVQARNLLSGIVQQQSNLLRAP
EAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

| 1696 | H405 | *ZM106.9-chim_DS_THS_v1v2-KER2018.11-201C/D368R/433C/R504T/V506T/L661N/L663T | ZM106.9/BG505 chimera | V1V2SOSIP; 664; R6; 201C, D368R, 433C, glycan504, glycan661 | V1V2 Swap KER2018.11, gly504-661 | |

AENLWTVYYGVPVWKEAKTLFCASDAKSYEREVHNVWATHACVPTDPDPQELVMANVTENFNMWKNDMVDQMHEDIISLWDQSLKPCVKLTPLCVTLNCINANVTNSSMTNSSMMEGEIKNCSYNMTT
ELRDKKRKVFSLFYKLDVVPMENNSEYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVE
IECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIR
GEIKCTSNITGLLLTRDGGNNNNSTEEIFRPEGGNMRDNWRSELYKYKVKIEPLGVAPTRCKRnvtGRRRRRRAVGIGAVFLGFLGAAGSTMGAASMTLTVQARNLLSGIVQQQSNLLRAPEAQQHL
LKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

| 1697 | H406 | *ZM106.9-chim_DS_THS_v1v2-CH070.1-201C/D368R/433C/R504T/V506T/L661N/L663T | ZM106.9/BG505 chimera | V1V2SOSIP; 664; R6; 201C, D368R, 433C, glycan504, glycan661 | V1V2 Swap CH070.1, gly504-661 | |

AENLWTVYYGVPVWKEAKTLFCASDAKSYEREVHNVWATHACVPTDPDPQELVMANVTENFNMWKNDMVDQMHEDIISLWDQSLKPCVKLTPLCVTLKCKDVSINNGNVSSSNGSTSHNNSSIDNETL
NEGMKEMKNCSFNATTVLRDKKKQKVHALFYKLNIVPIDENNSSSRYRLISCNTSTCTQACPKVSFDPIPIHYCAPAGYAILKCNNNKTFSGKGPCSNVSTVQCTHGIRPVVSTQLLLNGSLAEEEIVIRSENLTDNAKTIIVHLNKS
VEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPP
IRGEIKCTSNITGLLLTRDGGNNNNSTEEIFRPEGGNMRDNWRSELYKYKVKIEPLGVAPTRCKRnvtGRRRRRRAVGIGAVFLGFLGAAGSTMGAASMTLTVQARNLLSGIVQQQSNLLRAPEAQQHL
LKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

| 1698 | H407 | *ZM106.9-chim_DS_THS_v1v2-ZM233.6-201C/D368R/433C/R504T/V506T/L661N/L663T | ZM106.9/BG505 chimera | V1V2SOSIP; 664; R6; 201C, D368R, 433C, glycan504, glycan661 | V1V2 Swap ZM233.6, gly504-661 | |

AENLWTVYYGVPVWKEAKTLFCASDAKSYEREVHNVWATHACVPTDPDPQELVMANVTENFNMWKNDMVDQMHEDIISLWDQSLKPCVKLTPLCVTLDCSTYNNTHNISKEMKICSFNMTTELRDKKR
KVNVLFYKLDLVPLTNSSNTNYRLISCNTSTCTQACPKVSFDPIPIHYCAPAGYAILKCNNNKTFSGKGPCSNVSTVQCTHGIRPVVSTQLLLNGSLAEEEIVIRSENLTDNAKTIIVHLNKSVEIECIR
PGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIKC
TSNITGLLLTRDGGNNNNSTEEIFRPEGGNMRDNWRSELYKYKVKIEPLGVAPTRCKRnvtGRRRRRRAVGIGAVFLGFLGAAGSTMGAASMTLTVQARNLLSGIVQQQSNLLRAPEAQQHLLKLTVWG
IKQLQARVLAVERYLRDQQLLGIWGCSGKLICCTNVPWNSSWSNRNLSEIWDNMTWLQWDKEISNYTQIIYGLLEESQNQQEKNEQDLNATD TABLE-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1699 | H408 | *ZM106.9-chim_DS_THS_v1v2-Q23-201C/D368R/433C/V506T/R504T/L661N/L663T<br>AENLWTVYYGVPVWKEAKTLFCASDAKSYEREVHNVWATHACVPTDPDPQELVMANVTENFNMWKNDMVDQMHEDIISLWDQSLKPCVKLTPLCVTLHCTNVTSVNTTGDREGLKNCSFNMTTELRDK RQKVYSLFYRLDIVPINENQGSEYRLLSCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECI RPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIK CTSNITGLLLTRDGGNNNNSTEEIFRPEGGNMRDNWRSELYKYKVVKIEPLGVAPTRCKRnvtGRRRRRAVGIGAVFLGFLGAAGSTMGAASMTLTVQARNLLSGIVQQQSNLLRAPEAQQHLLKLTVW GIKQLQARVLAVERYLRDQQLLGIWGCSGKLICCTNVPWNSSWSNRNLSEIWDNMTWLQWDKEISNYTQIIYGLLEESQNQQEKNEQDLNATD | ZM106.9/BG505 chimera | V1V2SOSIP; 664; R6; 201C, D368R, 433C, glycan504, glycan661 | V1V2 Swap Q23, gly504-661 | |
| 1700 | H409 | *ZM106.9-chim_DS_THS_v1v2-A244-201C/D368R/433C/R504T/V506T/L661N/L663T<br>AENLWTVYYGVPVWKEAKTLFCASDAKSYEREVHNVWATHACVPTDPDPQELVMANVTENFNMWKNDMVDQMHEDIISLWDQSLKPCVKLTPLCVTLHCTNANLTKANLTNVNNRTNVSNIIGNITDE VRNCSFNMTTELRDKKQKVHALFYKLDIVPIEDNNDNSKYRLLSCNTSTCTQACPKVSFDPIPIHYCAPAGYAILKCNNKTFSGKGPCSNVSTVQCTHGIRPVVSTQLLLNGSLAEEEIVIRSENLTDNA KTIIVHLNKSVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQ GVGRCMYAPPIRGELKCTSNITGLLLTRDGGNNNNSTEELFRPEGGNMRDNWRSELYKYKVVKIEPLGVAPTRCKRnvtGRRRRRRAVGIGAVFLGFLGAAGSTMGAASMTLTVQARNLLSGIVQQQSNL LRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD | ZM106.9/BG505 chimera | V1V2SOSIP; 664; R6; 201C, D368R, 433C, glycan504, glycan661 | V1V2 Swap A244, gly504-661 | |
| 1701 | H410 | *ZM106.9-chim_DS_THS_v1v2-WITO-201C/D368R/433C/R504T/V506T/L661N/L663T<br>AENLWTVYYGVPVWKEAKTLFCASDAKSYEREVHNVWATHACVPTDPDPQELVMANVTENFNMWKNDMVDQMHEDIISLWDQSLKPCVKLTPLCVTLHCTNVTISSTNGSTANVTMREEMKNCSFNTT TVIRDKIQKEYALFYKLDIVPIEGKNTNTGYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNK SVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAP PIRGELKCTSNITGLLLTRDGGNNNNSTEEIFRPEGGNMRDNWRSELYKYKVVKIEPLGVAPTRCKRnvtGRRRRRRAVGIGAVFLGFLGAAGSTMGAASMTLTVQARNLLSGIVQQQSNLLRAPEAQQH LLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD | ZM106.9/BG505 chimera | V1V2SOSIP; 664; R6; 201C, D368R, 433C, glycan504, glycan661 | V1V2 Swap WITO, gly504-661 | |
| 1702 | H411 | *ZM106.9-chim_DS_THS_v1v2-Cap256-SU-201C/D368R/433C/R504T/V506T/L661N/L663T<br>AENLWTVYYGVPVWKEAKTLFCASDAKSYEREVHNVWATHACVPTDPDPQELVMANVTENFNMWKNDMVDQMHEDIISLWDQSLKPCVKLTPLCVTLNCSDAKVNINATYNGTREEIKNCSFNATTEL RDKKKKEYALFYRLDIVPLNKEGNNNSEYRLLSCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSV EIECIRPGNNTRKSIRLGPGQTFYATGDVIGDIRKAYCKNGSEWNETLTKVSEKLKEYFNKTIRFAQHSGGRLEVTTHSFNCRGEFFYCNTSELFNSNATESNITLPCRIKQIINMWQGVGRCMYAPPIR GEIKCTSNITGLLLTRDGGNNNNSTEEIFRPEGGNMRDNWRSELYKYKVVKIEPLGVAPTRCKRnvtGRRRRRRAVGIGAVFLGFLGAAGSTMGAASMTLTVQARNLLSGIVQQQSNLLRAPEAQQHLLK LTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD | ZM106.9/BG505 chimera | V1V2SOSIP; 664; R6; 201C, D368R, 433C, glycan504, glycan661 | V1V2 Swap CAP256-SU, gly504-661 | |

-continued

| SEQ ID NO | Code | Name | Native Background | Mutations Compared to Native Background | Additional mutations | Comment |
|---|---|---|---|---|---|---|
| 1703 | H412 | *ZM106.9-chim_DS_THS_v1v2-T250.4-201C/D368R/433C/R504T/V506T/L661N/L663T | ZM106.9/BG505 chimera | V1V2SOSIP; 664; R6; 201C, D368R, 433C, glycan504, glycan661 | V1V2 Swap T250.4, gly504-661 | |
| | | AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLDCQAFNSSSHTNSSIAMQEMKNCSFNVTTEL RDKKKKEYSFFYKTDIEQINKNGRQYRLISCNTSTCTQACPKVSFDPIPIHYCAPAGYAILKCNNKTFSGKGPCSNVSTVQCTHGIRPVVSTQLLNGSLAEEEIVIRSENLTDNAKTIIVHLNKSVEIE CIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGE IKCTSNITGLLLTRDGGNNNSTEEIFRPEGGNMRDNWRSELYKYKVVKIEPLGVAPTRCKRnvtGRRRRRAVGIGAVFLGFLGAAGSTMGAASMTLTVQARNLLSGIVQQQSNLLRAPEAQQHLLKLT VWGIKQLQARVLAVERYLRDQQLLGIWGCSGKLICCTNVPWNSSWSNRNLSEIWDNMTWLQWDKEISNYTQIIYGLLEESQNQQEKNEQDLNATD | | | | |
| 1704 | H413 | *ZM106.9-chim_DS_THS_v1v2-BB201.B42-201C/433C/D368R/R504T/V506T/L661N/L663T | ZM106.9/BG505 chimera | V1V2SOSIP; 664; R6; 201C, D368R, 433C, glycan504, glycan661 | V1V2 Swap BB201.B42, gly504-661 | |
| | | AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLECRNITGVNISEGKEEIKNCSFNIITELRDK RKKVYSLFYRLDVVQIDEGDKNSTQYRLISCNTSTCTQACPKVSFDPIPIHYCAPAGYAILKCNNKTFSGKGPCSNVSTVQCTHGIRPVVSTQLLNGSLAEEEIVIRSENLTDNAKTIIVHLNKSVEIE CIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGE IKCTSNITGLLLTRDGGNNNSTEEIFRPEGGNMRDNWRSELYKYKVVKIEPLGVAPTRCKRnvtGRRRRRAVGIGAVFLGFLGAAGSTMGAASMTLTVQARNLLSGIVQQQSNLLRAPEAQQHLLKLT VWGIKQLQARVLAVERYLRDQQLLGIWGCSGKLICCTNVPWNSSWSNRNLSEIWDNMTWLQWDKEISNYTQIIYGLLEESQNQQEKNEQDLNATD | | | | |
| 1705 | H414 | *cap256-su-chim_ds_THS-Avi | cap256-su | SOSIP, R6, 664, 201C/433C | | |
| | | AENLWVTVYYGVPVWKDAETTLFCASDAKAETTLFCASDAKSYEKEVHNVWATHACVPTDPNPQELVLKNVTENFNMWKNDMVDQMHEDIISLWDQSLKPCVKLTPLCVTLNCSDAKVNIATYNGTREEIKNCSFNATTEL RDKKKKEYALFYRLDIVPLNKEGNNNSEYRLINCNTSVCTQACPKVTFDPIPIHYCAPAGFAILKCNNKTFNGTGPCNNVSTVQCTHGIKPVVSTQLLNGSLAEEEIIRSENLTDNVKTIIVHLNESV EINCTRPNNNTRKSIRIGPGQTFYATGDIIGDIRQAHCNISEIKWEKTLQRVSEKLREHFNKTIIFNQSSGDLEITTHSFNCGGEFFYCNTSDLFFNKITFDETYSTGSNTNSTITLPCRIKQIINMWQ EVGRCMYASPIAGEITCKSNITGLLLTRDGGGNNSTEETFRPGGGNMRDNWRSELYKYKVKIEPLGVAPTRCKRRVVGRRRRRAVGIGAVFLGFLGAAGSTMGAASMTLTVQARNLLSGIVQQQSNLL RAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | |
| 1706 | H415 | *cap256-su-chim + int_ds_THS-Avi | cap256-su | SOSIP, R6, 664, 201C/433 | Interacting residues between the gp41 and gp120 | |
| | | AENLWVTVYYGVPVWKDAETTLFCASDAKSYEKEVHNVWATHACVPTDPNPQEIHLENVTENFNMWKNNMVEQMHTDIISLWDQSLKPCVKLTPLCVTLNCSDAKVNIATYNGTREEIKNCSFNATTEL RDKKKKEYALFYRLDIVPLNKEGNNNSEYRLINCNTSVCTQACPKVTFDPIPIHYCAPAGFAILKCNNKTFNGTGPCNNVSTVQCTHGIKPVVSTQLLNGSLAEEEIIRSENLTDNVKTIIVHLNESV EINCTRPNNNTRKSIRIGPGQTFYATGDIIGDIRQAHCNISEIKWEKTLQRVSEKLREHFNKTIIFNQSSGDLEITTHSFNCGGEFFYCNTSDLFFNKITFDETYSTGSNTNSTITLPCRIKQIINMWQ EVGRCMYASPIAGEITCKSNITGLLLTRDGGGNNSTEETFRPGGGNMRDNWRSELYKYKVVKIEPLGVAPTRCKRRVVGRRRRRAVGIGAVFLGFLGAAGSTMGAASMTLTVQARNLLSGIVQQQSNLL RAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | |

| SEQ ID NO | Code | Name | Native Background | Mutations Compared to Native Background | Additional mutations | Comment |
|---|---|---|---|---|---|---|
| 1707 | H416 | *426c-native_bg505-NCgp120 + gp41.SOSIP 426c/BG505 chimera | 426c/BG505 chimera | AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKNLSDNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGNTNNTEIFRPGGGDMDNWRSELYKYKVVKIEPLGVAPTRCKRRVVGRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | SOSIP; 664; R6 | |
| 1708 | H417 | *426c-del276-460_bg505-NCgp120 + gp41.SOSIP | 426c/BG505 chimera | AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKNLaDNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGNTaNNTEIFRPGGGDMRDNWRSELYKYKVVKIEPLGVAPTRCKRRVVGRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | SOSIP; 664; R6 | removal of glycan 276 |
| 1709 | H418 | *426c-del276_bg505-NCgp120 + gp41.SOSIP 426c/BG505 chimera | 426c/BG505 chimera | AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKNLaDNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGNTaNNTEIFRPGGGDMRDNWRSELYKYKVVKIEPLGVAPTRCKRRVVGRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | SOSIP; 664 | removal of glycan 276 |
| 1710 | H419 | *426c-del276-460_DS bg505-NCgp120 + gp41.SOSIP | 426c/BG505 chimera | AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTCTQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTaNNTEIFRPGGGDMRDNWRSELYKYKVV1KIEPLGVAPTRCKRRVVGRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | SOSIP, R6, 664, 201C/433C | removal of glycan 276 and glycan 460 |

-continued

| SEQ ID NO | Code | Name | Native Background | Mutations Compared to Native Background | Additional mutations | Comment |
|---|---|---|---|---|---|---|
| 1711 | H420 | *426c-del276 DS bg505-NCgp120 + gp41.SOSIP | 426c/BG505 chimera | SOSIP, R6, 664, 201C/433C | | removal of glycan 276 |
| | | AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSTDNTTLGEIKNCS FDITTEIRDKIRKEYALFYRLDIVPLDNSSNPNSSNTYRLINCNTSTCTQACPKVTFDPIPIHYCAPAGYAILKCNNKTFNGKGPCNNVSTVQCTHGIKPVVSTQLLLNGSLAEEEIVIRSKNLaDNAKI IIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEV GKCIYAPPIKGNITCKSDITGLLLLRDGNTTNNTEIFRPGGGDMDNWRSELYKYKVVKIEPLGVAPTRCKRRVVGRRRRRAVGIGAVFLGFLGAAGSTMGAASMTLTVQARNLLSGIVQQQSNLLRA PEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | |
| 1712 | H421 | *426c-native DS bg505-NCgp120 + gp41.SOSIP | 426c/BG505 chimera | SOSIP, R6, 664, 201C/433C | | |
| | | AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSTDNTTLGEIKNCS FDITTEIRDKIRKEYALFYRLDIVPLDNSSNPNSSNTYRLINCNTSTCTQACPKVTFDPIPIHYCAPAGYAILKCNNKTFNGKGPCNNVSTVQCTHGIKPVVSTQLLLNGSLAEEEIVIRSKNLSDNAKI IIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEV GKCIYAPPIKGNITCKSDITGLLLLRDGNTTNNTEIFRPGGGDMDNWRSELYKYKVVKIEPLGVAPTRCKRRVVGRRRRRAVGIGAVFLGFLGAAGSTMGAASMTLTVQARNLLSGIVQQQSNLLRA PEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | |
| 1713 | H422 | *426c-d3GLY-SUstrC_bg505-NCgp120 + gp41.SOSIP | 426c/BG505 chimera | SOSIP; 664; R6 | Introduction of su strand c | |
| | | AENLWVTVYYGVPVWKEAKTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSTDNTTLGEIKNCS FnattelrdkkKEYALFYRLDIVPLDNSSNPNSSNTYRLINCNTSLITQACPKVTFDPIPIHYCAPAGYAILKCNNKTFNGKGPCNNVSTVQCTHGIKPVVSTQLLLNGSLAEEEIVIRSKNLaDNAKI IIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEV GKAIYAPPIKGNITCKSDITGLLLLRDGGNTaNNaElFRPGGGDMRDNWRSELYKYKVVKIEPLGVAPTRCKRRVVGRRRRRAVGIGAVFLGFLGAAGSTMGAASMTLTVQARNLLSGIVQQQSNLLRA PEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | |
| 1714 | H423 | *426c-d3GLY-SUstrC_DS bg505-NCgp120 + 3Ogp41.SOSIP | 426c/BG505 chimera | SOSIP, R6, 664, 201C/433C | Introduction of su strand c | |
| | | AENLWVTVYYGVPVWKEAKTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSTDNTTLGEIKNCS FnattelrdkkKEYALFYRLDIVPLDNSSNPNSSNTYRLINCNTSCTQACPKVTFDPIPIHYCAPAGYAILKCNNKTFNGKGPCNNVSTVQCTHGIKPVVSTQLLLNGSLAEEEIVIRSKNLaDNAKI IIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEV GKCIYAPPIKGNITCKSDITGLLLLRDGGNTaNNaElFRPGGGDMRDNWRSELYKYKVVKIEPLGVAPTRCKRRVVGRRRRRAVGIGAVFLGFLGAAGSTMGAASMTLTVQARNLLSGIVQQQSNLLRA PEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | |

-continued

| SEQ ID NO | Code | Name | Native Background | Mutations Compared to Native Background | Additional mutations | Comment |
|---|---|---|---|---|---|---|
| 1715 | H424 | *703010505.TF-chim_d7324, R6, 664, I201C/A433C<br>AENLWTVYYGVPVWKEAKTTLFCASDAKAYEKEVHNVWATHACVPTDPNPQEMVLKNVTENFNMWKNDMVDQMHEDVISLMDQSLKPCVKLTPLCVTLNCTNATASNSSIIEGMKNCSFNITTELRDKR<br>EKKNALFYKLDIVQLDGNSSQYRLNCNTSVITQACPKVSFDPIPIHYCAPAGYAILKCNNKTFGTGPCNNVSTVQCTHGIKPVVSTQLLNGSLAEGEIIIRSENITNNVKTIIVHLNESVKIECTRP<br>NNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITHCRIKQIINMWQEVG<br>RAMYAPPIAGNITCISNITGLLLTRDGGKNNTETFRPGGGNMKDNWRSELYKYKVKCEIEPLGVAPTRCKRRVVGRRRRRRAVGIGAVFLGFLGAAGSTMGAASMTLTVQARNLLSGIVQQQSNLLRAP<br>EAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | 703010505.TF/BG505 chimera | SOSIP, R6, 664 | I201C/A433C | |
| 1716 | H425 | 703010505.TF-chim + int_d7324, R6, 664, I201C/A433C | 703010505.TF/BG505 chimera | SOSIP, R6, 664 | I201C/A433C | interface mutations |
| 1717 | H426 | 703010505.TF_cl-small-sel_d7324, R6, 664, I201C/A433C | 703010505.TF/BG505 chimera | SOSIP, R6, 664 | I201C/A433C | |
| 1718 | H427 | 703010505.TF_cl1-2_d7324, R6, 664, I201C/A433C | 703010505.TF/BG505 chimera | SOSIP, R6, 664 | I201C/A433C | |
| 1719 | H428 | 703010505.TF_cl1_0324, R6, 664, I201C/A433C | 703010505.TF/BG505 chimera | SOSIP, R6, 664 | I201C/A433C | |
| 1720 | H429 | 703010505.TF-chim d7324 tad, R6, 664, I201C/A433C/E47D/K49E/V65K/E106T/E429R/R432Q/E500R | 703010505.TF/BG505 chimera | SOSIP, R6, 664 | I201C/A433C | trimer association domain mutations |
| 1721 | H430 | 703010505.TF_cl-small-sel_d7324 tad, R6, 664, I201C/A433C/E47D/K49E/V65K/E106T/E429R/R432Q/E500R | 703010505.TF/BG505 chimera | SOSIP, R6, 664 | I201C/A433C | trimer association domain mutations |
| 1722 | H431 | 703010505.TF_cl1-2_d7324_tad, R6, 664, I201C/A433C/E47D/K49E/V65K/E106T/E429R/R432Q/E500R | 703010505.TF/BG505 chimera | SOSIP, R6, 664 | I201C/A433C | trimer association domain mutations |
| 1723 | H432 | 703010505.TF_cl1_0324 tad, R6, 664, I201C/A433C/E47D/K49E/V65K/E106T/E429R/R432Q/E500R | 703010505.TF/BG505 chimera | SOSIP, R6, 664 | I201C/A433C | trimer association domain mutations |
| 1724 | H433 | 703010505.TF-chim + int_d7324 tad, R6, 664, I201C/A433C/E47D/K49E/V65K/E106T/E429R/R432Q/E500R | 703010505.TF/BG505 chimera | SOSIP, R6, 664 | I201C/A433C | interface mutations, trimer association domain mutations |
| 1725 | H434 | JRFLgp140.6R.SOSIP.664.E168K, BG505 gp41 chim, I201C, A433C, | JRFL/BG505 chim | SOSIP, R6, 664 | E168K, I201C, A433C, | DS |

-continued

| SEQ ID NO | Code | Name | Native Background | Mutations Compared to Native Background | Additional mutations | Comment |
|---|---|---|---|---|---|---|
| 1726 | H435 | JRFLgp140.6R.SOSIP.664.E168K, BG505 gp41 chim, + int I201C, A433C, | JRFL/BG505 chim | SOSIP, R6, 664 | E168K, + interface residues, I201C, A433C, | |
| 1727 | H436 | JRFLgp140.6R.SOSIP.664.E168K, BG505 gp41 chim, I201C, A433C,_v2 | JRFL/BG505 chim | SOSIP, R6, 664 | E168K,, I201C, A433C,_BG505 V2 (residues 154-205), | V2 from BG505 |
| 1728 | H437 | JRFLgp140.6R.SOSIP.664.E168K, BG505 gp41 chim, I201C, A433C,_v1_191-205 | JRFL/BG505 chim | SOSIP, R6, 664 | E168K,, I201C, A433C,_BG505 V1 (residues 119-153),_191-205 | V1, 191-205 from BG505 |
| 1729 | H438 | JRFLgp140.6R.SOSIP.664.E168K, BG505 gp41 chim, + int I201C, A433C,_v1 | JRFL/BG505 chim | SOSIP, R6, 664 | E168K,, + interface residues, I201C, A433C,_BG505 V1 (residues 119-153), | V1 from BG505 |
| 1730 | H439 | JRFLgp140.6R.SOSIP.664.E168K, BG505 gp41 chim, I201C, A433C,_strC | JRFL/BG505 chim | SOSIP, R6, 664 | E168K,, I201C, A433C,_strC | 166-173 from BG505 |
| 1731 | H440 | JRFLgp140.6R.SOSIP.664.E168K, BG505 gp41 chim, + int I201C, A433C,_strC | JRFL/BG505 chim | SOSIP, R6, 664 | E168K,, + interface residues, I201C, A433C,_strC | 166-173 from BG505 |
| 1732 | H441 | *JRFLgp140.6R.SOSIP.664.E168K, BG505 gp41 chim, I201C, A433C,_v2_v3 | JRFL/BG505 chim | SOSIP, R6, 664 | E168K, I201C, A433C,_BG505 V2 (residues 154-205),_BG505 V3 (residues 296-331), | V2, V3 from BG505 |

AENLWVTVYYGVPVWKEATTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGELKNCSFNMT
TELRDKKQKVVSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTI
IVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRI
KQIINMWQEVGKCMYAPPIRGGQIRCSSNITGLLLTRDGGINENGTEIFRPGGGDMRDNWRSELYKYKVVKIEPLGVAPTRCKRRVVGRRRRRAVGIGAVFLGFLGAAGSTMGAASMTLTVQARNLLSGI
VQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

| 1733 | H442 | JRFLgp140.6R.SOSIP.664.E168K, BG505 gp41 chim, I201C, A433C,_v1_strC_191-205 | JRFL/BG505 chim | SOSIP, R6, 664 | E168K, I201C, A433C,_BG505 V1 (residues 119-153),_strC_191-205 | V1, 191-205, 166-173 from BG505 |

| SEQ ID NO | Code | Name | Native Background | Mutations Compared to Native Background | Additional mutations | Comment |
|---|---|---|---|---|---|---|
| 1734 | H443 | JRFLgp140.6R.SOSIP.664.E168K, BG505 gp41 chim, + int I201C, A433C, _v1_strC | JRFL/BG505 chim | SOSIP, R6, 664 | E168K,, + interface residues, I201C, A433C,_ BG505 V1 (residues 119-153),_strC | V1, 166-173 from BG505 |
| 1735 | H444 | *JRFLgp140.6R.SOSIP.664.E168K, BG505 gp41 chim, I201C, A433C,_v3 | JRFL/BG505 chim | SOSIP, R6, 664 | E168K, I201C, A433C,_ BG505 V3 (residues 296-331), | V3 from BG505 |
| | | AENLWVTVYYGVPVWKEATTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVIRSDNFTNNAKTIIVQLKESVEINCTRPNNNTRKSIRIGPGQAFYATGDIIGDIRQAHCNISRAKWNDTLKQIVIKLREQFENKTIVFNHSSGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | |
| 1736 | H445 | *JRFLgp140.6R.SOSIP.664.E168K, BG505 gp41 chim, + int I201C, A433C,_strC_v3 | JRFL/BG505 chim | SOSIP, R6, 664 | E168K, + interface residue set A, I201C, A433C,_strC BG505 V3 (residues 296-331), | 166-173, V3 from BG505 |
| | | AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITSIRDKKQKVALFYKLDVVPIDNNTSYRLIRIGPGQAFYATGDIGDIRQAHCNISRAKWNDTLKQIVIKLREQFENKTIVFNHSSGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | |
| 1737 | H446 | JRFLgp140.6R.SOSIP.664.E168K, BG505 gp41 chim, + int I201C, A433C,_v2 | JRFL/BG505 chim | SOSIP, R6, 664 | E168K, + interface residues, I201C, A433C,_ BG505 V2 (residues 154-205), | V2 from BG505 |
| 1738 | H447 | *JRFLgp140.6R.SOSIP.664.E168K, BG505 gp41 chim, + int I201C, A433C,_191-205_v3 | JRFL/BG505 chim | SOSIP, R6, 664 | E168K, + interface residue set A, I201C, A433C,_191-205 BG505 V3 (residues 296-331), | 191-205, V3 from BG505 |
| | | AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITSIRDKVQKEYALFYKLDVVPIDNNNTSAITQACPKISFEPIPIHYCAPAGFAILKCNDKTFNGKGPCKNVSTVQCTHGIRPVVSTQLLLNGSLAEEEVIRSDNFTNNAKTIIVQLKESVEINCTRPNNNTRKSIRIGPGQAFYATGDIIGDIRQAHCNISRAKWNDTLKQIVIKLREQFENKTIVFNHSSGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | |

| SEQ ID NO | Code | Name | Native Background | Mutations Compared to Native Background | Additional mutations | Comment |
|---|---|---|---|---|---|---|
| 1739 | H448 | *JRFLgp140.6R.SOSIP.664.E168K, BG505 gp41 chim, + int I201C, A433C,_v1_v3 | JRFL/BG505 chim | SOSIP, R6, 664 | E168K, + interface residue set A, I201C, A433C,_BG505 V1 (residues 119-153),_BG505 V3 (residues 296-331), | V1, V3 from BG505 |
| | | AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGELKNCSFNITTSIRDK VQKEYAFYKLDVVPIDNNNTSYRLISCDTSVCTQACPKISFEPIPIHYCAPAGFAILKCNDTKFNGKGPCKNVSTVQCTHGIRPVVSTQLLNGSLAEEEVIRSDNFTNNAKTIIVQLKESVEINCTR PNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCM YAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQ QHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | | |
| 1740 | H449 | *JRFLgp140.6R.SOSIP.664.E168K, BG505 gp41 chim, I201C, A433C,_strC_v3 | JRFL/BG505 chim | SOSIP, R6, 664 | E168K, I201C, A433C,_ strC_BG505 V3 (residues 296-331), | 166-173, V3 from BG505 |
| | | AENLWVTVYYGVPVWKEATTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNIT TSIRDKVQKVYALFYKLDVVPIDNNNTSYRLISCDTSVCTQACPKISFEPIPIHYCAPAGFAILKCNDTFNGKGPCKNVSTVQCTHGIRPVVSTQLLNGSLAEEEVIRSDNFTNNAKTIIVQLKESV EINCTRPNNNTRKSIRIGPGQAFYATGDIIGDIRQAHCNISRAKWNDTLKQIVIKLREQFENKTIVFNHSSGEPFYCNSTQLFNSTWNNNTEGSNNTEGNTITLPCRIKQIINMWQ EVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLL RAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | | |
| 1741 | H450 | *JRFLgp140.6R.SOSIP.664.E168K, BG505 gp41 chim, + int I201C, A433C,_ | JRFL/BG505 chim | SOSIP, R6, 664 | E168K, + interface residue set A, I201C, A433C,_BG505 V3 (residues 296-331), | V3 from BG505 |
| | | AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNIT TSIRDKVQKVYALFYKLDVVPIDNNNTSYRLISCDTSVCTQACPKISFEPIPIHYCAPAGFAILKCNDTFNGKGPCKNVSTVQCTHGIRPVVSTQLLNGSLAEEEVIRSDNFTNNAKTIIVQLKESV EINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQ EVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLL RAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | | |
| 1742 | H451 | *JRFLgp140.6R.SOSIP.664.E168K, BG505 gp41 chim, + int I201C, A433C,_v2_v3 | JRFL/BG505 chim | SOSIP, R6, 664 | E168K, + interface residue set A, I201C, A433C,_BG505 V2 (residues 154-205),_BG505 V3 (residues 296-331), | V2, V3 from BG505 |
| | | AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGELKNCSFNMT TELRDKKQKVYSLFYRLDVVQINENQGNRSNNSNKEYRLLINCNTSAITQACPKISFEPIPIHYCAPAGFAILKCNDKTFNGKGPCKNVSTVQCTHGIRPVVSTQLLFNSTWNNNTEGSNNTEGNTITLPCRI IVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRI KQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGI VQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | | | | | |

-continued

| SEQ ID NO | Code | Name | Native Background | Mutations Compared to Native Background | Additional mutations | Comment |
|---|---|---|---|---|---|---|
| 1743 | H452 | JRFLgp140.6R.SOSIP.664.E168K, BG505 gp41 chim, I201C, A433C,_v1_strC_191-205_v3 | JRFL/BG505 chim | SOSIP, R6, 664 | E168K, I201C, A433C,_BG505 V1 (residues 119-153),_strC_191-205_BG505 V3 (residues 296-331) | V1, 166-173, 191-205, V3 from BG505 |
| 1744 | H453 | *JRFLgp140.6R.SOSIP.664.E168K, BG505 gp41 chim, + int I201C, A433C,_v1_strC_v3<br><br>AENLWTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDMRGEIKNCSFNITTSIRDK KQKVYALFYKLLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTR PNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCM YAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQ QHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | JRFL/BG505 chim | SOSIP, R6, 664 | E168K, + interface residue set A, I201C, A433C,_BG505 V1 (residues 119-153),_strC_BG505 V3 (residues 296-331) | V1, 166-173, V3 from BG505 |
| 1745 | H454 | JRFLgp140.6R.SOSIP.664.E168K, BG505 gp41 chim, I201C, A433C,_191-205 | JRFL/BG505 chim | SOSIP, R6, 664 | E168K, I201C, A433C,_191-205 | 191-205 from BG505 |
| 1746 | H455 | JRFLgp140.6R.SOSIP.664.E168K, BG505 gp41 chim, + int I201C, A433C,_191-205 | JRFL/BG505 chim | SOSIP, R6, 664 | E168K, + interface residues, I201C, A433C,_191-205 | 191-205 from BG505 |
| 1747 | H456 | JRFLgp140.6R.SOSIP.664.E168K, BG505 gp41 chim, I201C, A433C,_v1_v2 | JRFL/BG505 chim | SOSIP, R6, 664 | E168K, I201C, A433C,_BG505 V1 (residues 119-153),_BG505 V2 (residues 154-205) | V1, V2 from BG505 |
| 1748 | H457 | JRFLgp140.6R.SOSIP.664.E168K, BG505 gp41 chim, I201C, A433C,_v1 | JRFL/BG505 chim | SOSIP, R6, 664 | E168K, I201C, A433C,_BG505 V1 (residues 119-153) | V1 from BG505 |
| 1749 | H458 | JRFLgp140.6R.SOSIP.664.E168K, BG505 gp41 chim, + int I201C, A433C,_v1_191-205 | JRFL/BG505 chim | SOSIP, R6, 664 | E168K, + interface residue set A, I201C, A433C,_BG505 V1 (residues 119-153),_191-205 | V1, 191-205 from BG505 |
| 1750 | H459 | JRFLgp140.6R.SOSIP.664.E168K, BG505 gp41 chim, I201C, A433C,_strC_191-205 | JRFL/BG505 chim | SOSIP, R6, 664 | E168K, I201C, A433C,_strC_191-205 | 166-173, 191-205 from BG505 |

-continued

| SEQ ID NO | Code | Name | Native Background | Mutations Compared to Native Background | Additional mutations | Comment |
|---|---|---|---|---|---|---|
| 1751 | H460 | JRFLgp140.6R.SOSIP.664 chim, + int I201C, A433C,_strC_191-205 | JRFL/BG505 chim SOSIP, R6, 664 | BG505 gp41 chim, I201C, A433C,_strC_191-205 | E168K, + interface residue set A, I201C, A433C,_strC_191-205 | 166-173, 191-205 from BG505 |
| 1752 | H461 | JRFLgp140.6R.SOSIP.664 chim, I201C, A433C,_v1_v2_v3 | JRFL/BG505 chim SOSIP, R6, 664 AENLMWTVYYGVPVWKEATTLFCASDAKAYDTEVHNVWATHACVPTDPNPQEVVLENVTEHFNMWKNNMVEQMQEDIISLWDQSLKPCVKLTPLCVTLQCTNVTNNITDDMRGELKNCSFNMTTELRDK KQKVYSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKE SVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINM WQEVGKCMYAPPIRGQIRCSSNITGLLLTRDGGINENGTEIFRPGGGDMRDNWRSELYKYKVVKIEPLGVAPTRCKRRVVGRRRRRAVGIGAVFLGFLGAAGSTMGAASMTLTVQARNLLSGIVQQQSN LLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | E168K,I201C, A433C,_BG505V1, V2, V3 from BG505 V1 (residues 119-153),_BG505 V2 (residues 154-205),_BG505 V3 (residues 296-331) | |
| 1753 | H462 | JRFLgp140.6R.SOSIP.664 chim, I201C, A433C,_v1_strC | JRFL/BG505 chim SOSIP, R6, 664 | BG505 gp41 chim, I201C, A433C,_v1_strC | E168K, I201C, A433C,_BG505 V1 (residues 119-153),_strC | V1, 166-173 from BG505 |
| 1754 | H463 | JRFLgp140.6R.SOSIP.664 chim, + int I201C, A433C,_v1_strC_191-205 | JRFL/BG505 chim SOSIP, R6, 664 | BG505 gp41 chim, I201C, A433C,_v1_strC_191-205 | E168K, + interface residue set A, I201C, A433C,_BG505 V1 (residues 119-153),_strC_191-205 | V1, 166-173, 191-205 from BG505 |
| 1755 | H464 | JRFLgp140.6R.SOSIP.664 chim, I201C, A433C,_strC_191-205_v3 | JRFL/BG505 chim SOSIP, R6, 664 | BG505 gp41 chim, I201C, A433C,_strC_191-205_v3 | E168K,I201C, A433C,_strC_191-205_BG505 V3 (residues 296-331), | 166-173, 191-205, V3 from BG505 |
| 1756 | H465 | JRFLgp140.6R.SOSIP.664 chim, E168K, I201C, A433C,_v1_191-205_v3 | JRFL/BG505 chim SOSIP, R6, 664 | BG505 gp41 chim, I201C, A433C,_v1_191-205_v3 | E168K, I201C, A433C,_BG505 V1 (residues 119-153),_191-205_BG505 V3 (residues 296-331), | V1, 191-205, V3 from BG505 |
| 1757 | H466 | JRFLgp140.6R.SOSIP.664 chim, E168K, I201C, A433C,_v1_v2 | JRFL/BG505 chim SOSIP, R6, 664 | BG505 gp41 chim, I201C, A433C,_v1_v2 | E168K, + interface residues, I201C, A433C,_BG505 V1 (residues 119-153),_BG505 V2 (residues 154-205), | V1, V2 from BG505 |

| SEQ ID NO | Code | Name | Native Background | Mutations Compared to Native Background | Additional mutations | Comment |
|---|---|---|---|---|---|---|
| 1758 | H467 | *JRFLgp140.6R.SOSIP.664.E168K, BG505 gp41 chim, I201C, A433C,_v1_v3 | JRFL/BG505 chim SOSIP, R6, 664 | AENLWVTVYYGVPVWKEATTLFCASDAKAYDTEVHNVWATHACVPTDPNPQEVLENVTEHFNMWKNNMVEQMQEDIISLWDQSLKPCVKLTPLCVTLQCTNVTNNITDDMRGEIKNCSFNITTSIRDK VQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTR PNNNTRKSIRIGPGQAFYATGDIIGDIRQAHCNISRAKWNDTLKQIVIKLREQFENKTIVFNHSSGGDFFYCNSTQLFNSTWNNNTEGSNNTEGNTITLPCRIKQIINMWQEVGKCM YAPPIRGQIRCSSNITGLLLTRDGGINENGTEIFRPGGGDMRDNWRSELYKYKVVKIEPLGVAPTRCKRRVVGRRRRRAVGIGAVFLGFLGAAGSTMGAASMTLTVQARNLLSGIVQQQSNLLRAPEAQ QHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | E168K, I201C, A433C,_ V1, V3 from BG505 BG505 V1 (residues 119- 153),_BG505 V3 (residues 296-331), |
| 1759 | H468 | *JRFLgp140.6R.SOSIP.664.E168K, BG505 gp41 chim, + int I201C, A433C,_v1_191- 205_v3 | JRFL/BG505 chim SOSIP, R6, 664 | AENLWVTVYYGVPVWKDAETTLFCASDAKAYDTEVHNVWATHACVPTDPNPQEIHLENVTEHFNMWKNNNMVEQMQTDIISLWDQSLKPCVKLTPLCVTLQCTNVTNNITDDMRGEIKNCSFNITTSIRDK VQKEYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTR PNNNTRKSIRIGPGQAFYATGDIIGDIRQAHCNISRAKWNDTLKQIVIKLREQFENKTIVFNHSSGGDFFYCNSTQLFNSTWNNNTEGSNNTEGNTITLPCRIKQIINMWQEVGKCM YAPPIRGQIRCSSNITGLLLTRDGGINENGTEIFRPGGGDMRDNWRSELYKYKVVKIEPLGVAPTRCKRRVVGRRRRRAVGIGAVFLGFLGAAGSTMGAASMTLTVQARNLLSGIVQQQSNLLRAPEAQ QHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | E168K, + interface V1, 191-205, V3 from BG505 residues, I201C, A433C,_ BG505 V1 (residues 119-153),_191-205_BG505 V3 (residues 296-331), |
| 1760 | H469 | *JRFLgp140.6R.SOSIP.664.E168K, BG505 gp41 chim, I201C, A433C,_191-205_v3 | JRFL/BG505 chim SOSIP, R6, 664 | AENLWVTVYYGVPVWKEATTLFCASDAKAYDTEVHNVWATHACVPTDPNPQEVLENVTEHFNMWKNNMVEQMQEDIISLWDQSLKPCVKLTPLCVTLPCVKLTPLCVTLNCKDVNATNTNDSEGTMERGEIKNCSFNIT TSIRDKVQKEYALFYKLDVVPIDNNNTSYRLLNCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESV EINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQ EVGKCMYAPPIRGQIRCSSNITGLLLTRDGGINENGTEIFRPGGGDMRDNWRSELYKYKVVKIEPLGVAPTRCKRRVVGRRRRRAVGIGAVFLGFLGAAGSTMGAASMTLTVQARNLLSGIVQQQSNLL RAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | E168K, + interface V1, A433C,_191-191-205, V3 from BG505 residues, I201C, A433C,_191-205 BG505 V3 (residues 296-331), |
| 1761 | H470 | *JRFLgp140.6R.SOSIP.664.E168K, BG505 gp41 chim, + int I201C, A433C,_strC_191-205_v3 | JRFL/BG505 chim SOSIP, R6, 664 | AENLWVTVYYGVPVWKDAETTLFCASDAKAYDTEVHNVWATHACVPTDPNPQEIHLENVTEHFNMWKNNNMVEQMQTDIISLWDQSLKPCVKLTPLCVTLNCKDVNATNTNDSEGTMERGEIKNCSFNIT TSIRDKKVQKVYALFYKLDVVPIDNNNTSYRLLNCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESV EINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQ EVGKCMYAPPIRGQIRCSSNITGLLLTRDGGINENGTEIFRPGGGDMRDNWRSELYKYKVVKIEPLGVAPTRCKRRVVGRRRRRAVGIGAVFLGFLGAAGSTMGAASMTLTVQARNLLSGIVQQQSNLL RAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | E168K, + interface 166-173, 191-205, V3 from BG505 residues, I201C, A433C,_ strC_191-205 BG505 V3 (residues 296-331), |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1762 | H471 | *JRFLgp140.6R.SOSIP.664.E168K, BG505 gp41 chim, + int I201C, A433C,_v1_v2_v3 AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGELKNCSFNMTTELRDK KQKVYSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKE SVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINM WQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSN LLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | JRFL/BG505 chim SOSIP, R6, 664 | E168K, + interface residues, I201C, A433C,_BG505V1 (residues 119-153),_BG505 V2 (residues 154-205),_BG505 V3 (residues 296-331), | V1, V2, V3 from BG505 |
| 1763 | H472 | *JRFLgp140.6R.SOSIP.664.E168K, BG505 gp41 chim, I201C, A433C,_v1_strCv3 AENLWVTVYYGVPVWKEATTLFCASDAKAYDTEVHNVWATHACVPTDPNPQEVVLENVTEHFNMWKNNMVEQMQEDIISLWDQSLKPCVKLTPLCVTLQCTNVTNNITDDMRGELKNCSFNITTSIRDK KQKVYALFYKILDVVPIDNNNTSYRLISCDTSVCTQACPKISFEPIPIHYCAPAGFAILKCNDKTFNGKPCKNVSTVQCTHGIRPVVSTQLLLNGSLAEEEVVIRSDNFTNNAKTIIVQLKESVEINCTR PNNNTRKSIRIGPGQAFYATGDIIDNNNTLKQIVIKLREQFENKTIVFNHSSGGDPEIVMHSFNCGGEFFYCNSTQLFNSTWNNNTEGSNNTEGNTITLPCRIKQIINMWQEVGKCM YAPPIRGQIRCSSNITGLLLTRDGGINENGTEIFRPGGGDMRDNWRSELYKYKVVKIEPLGVAPTRCKRRVVGRRRRRAVGIGAVFLGFLGAAGSTMGAASMTLTVQARNLLSGIVQQQSNLLRAPEAQ QHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD | JRFL/BG505 chim SOSIP, R6, 664 | E168K, I201C, A433C,_BG505 V1 (residues 119-153),_strC BG505 V3 (residues 296-331), | V1, 166-173, V3 from BG505 |
| 1764 | H473 | JRFLgp140.6R.SOSIP.664.E168K, BG505 gp41 chim, + int I201C, A433C,_v1_strC_191-205_v3 | JRFL/BG505 chim SOSIP, R6, 664 | E168K, + interface residues, I201C, A433C,_BG505 V1 (residues 119-153),_strC_191-205_BG505 V3 (residues 296-331), | V1, 166-173, 191-205, V3 from BG505 |
| 1765 | T030 | TH966.8-chim_sc10ln-IP-10ln-HATM | TH966.8/BG505 chimera | sc10ln-IP-10ln-HATM | |
| 1766 | T031 | 6545.V4.C1-chim_sc10ln-IP-10ln-HATM | 6545.V4.C1/BG505 chimera | sc10ln-IP-10ln-HATM | |
| 1767 | T032 | R2184.c4-chim_sc10ln-IP-10ln-HATM | R2184.c4/BG505 chimera | sc10ln-IP-10ln-HATM | |
| 1768 | T033 | ZM197.7-chim_sc10ln-IP-10ln-HATM | ZM197.7/BG505 chimera | sc10ln-IP-10ln-HATM | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1769 | T034 | ZM106.9-chim_sc101n-IP-101n-HATM | ZM106.9/BG505 chimera | sc101n-IP-101n-HATM | | |
| 1770 | T035 | ZM53.12-chim_sc101n-IP-101n-HATM | ZM53.12/BG505 chimera | sc101n-IP-101n-HATM | | |
| 1771 | T036 | R2184.c4-chim_sc101n-IP-MPER-TM | R2184.c4/BG505 chimera | sc101n-IP-MPER-TM | | |
| 1772 | T037 | CNE55-chim_sc101n-IP-101n-HATM | CNE55/BG505 chimera | sc101n-IP-101n-HATM | | |
| 1773 | T038 | 6545.V4.C1-chim_sc101n-IP-MPER-TM | 6545.V4.C1/BG505 chimera | sc101n-IP-MPER-TM | | |
| 1774 | T039 | DU422.01-chim_sc101n-IP-101n-HATM | DU422.01/BG505 chimera | sc101n-IP-101n-HATM | | |
| 1775 | T040 | 25925-2.22-chim_sc101n-IP-101n-HATM | 25925-2.22/BG505 chimera | sc101n-IP-101n-HATM | | |
| 1776 | T041 | CNE58-chim_sc101n-IP-101n-HATM | CNE58/BG505 chimera | sc101n-IP-101n-HATM | | |
| 1777 | T042 | 16055-2.3-chim_sc101n-IP-101n-HATM | 16055-2.3/BG505 chimera | sc101n-IP-101n-HATM | | |
| 1778 | T043 | TH966.8-chim_sc101n-IP-MPER-TM | TH966.8/BG505 chimera | sc101n-IP-MPER-TM | | |
| 1779 | T044 | ZM55.28a-chim_sc101n-IP-MPER-TM | ZM55.28a/BG505 chimera | sc101n-IP-MPER-TM | | |
| 1780 | T045 | ZM53.12-chim_sc101n-IP-MPER-TM | ZM53.12/BG505 chimera | sc101n-IP-MPER-TM | | |
| 1781 | T046 | B1369.9A-chim_sc101n-IP-101n-HATM | B1369.9A/BG505 chimera | sc101n-IP-101n-HATM | | |
| 1782 | T047 | ZM197.7-chim_sc101n-IP-MPER-TM | ZM197.7/BG505 chimera | sc101n-IP-MPER-TM | | |
| 1783 | T048 | 16055-2.3-chim_sc101n-IP-MPER-TM | 16055-2.3/BG505 chimera | sc101n-IP-MPER-TM | | |
| 1784 | T049 | ZM55.28a-chim_sc15in-SOS-DS-101n-HATM | ZM55.28a/BG505 chimera | sc15in-SOS-DS-101n-HATM | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1785 | T050 | ZM106.9-chim_SOS-DS-10ln-HATM | ZM106.9/BG505 chimera | SOS-DS-10ln-HATM | | |
| 1786 | T051 | AC10.29-chim_SOS-DS-10ln-HATM | AC10.29/BG505 chimera | SOS-DS-10ln-HATM | | |
| 1787 | T052 | CH038.12-chim_SOS-DS-10ln-HATM | CH038.12/BG505 chimera | SOS-DS-10ln-HATM | | |
| 1788 | T053 | TRO.11-chim_SOS-DS-10ln-HATM | TRO.11/BG505 chimera | SOS-DS-10ln-HATM | | |
| 1789 | T054 | QH209.14M.A2-chimSOS-DS-10ln-HATM | QH209.14M.A2/BG505 chimera | SOS-DS-10ln-HATM | | |
| 1790 | T055 | 6545.V4.C1-chim_SOS-DS-10ln-HATM | 6545.V4.C1/BG505 chimera | SOS-DS-10ln-HATM | | |
| 1791 | T056 | KER2018.11-chim_SOS-DS-10ln-HATM | KER2018.11/BG505 chimera | SOS-DS-10ln-HATM | | |
| 1792 | T057 | MB201.A1-chim_SOS-DS-10ln-HATM | MB201.A1/BG505 chimera | SOS-DS-10ln-HATM | | |
| 1793 | T058 | B1369.9A-chim_SOS-DS-10ln-HATM | B1369.9A/BG505 chimera | SOS-DS-10ln-HATM | | |
| 1794 | T059 | CNE55-chim_SOS-DS-10ln-HATM | CNE55/BG505 chimera | SOS-DS-10ln-HATM | | |
| 1795 | T060 | TH966.8-chim_SOS-DS-10ln-HATM | TH966.8/BG505 chimera | SOS-DS-10ln-HATM | | |
| 1796 | T061 | R2184.c4-chim_SOS-DS-10ln-HATM | R2184.c4/BG505 chimera | SOS-DS-10ln-HATM | | |
| 1797 | T062 | DU422.01-chim_SOS-DS-10ln-HATM | DU422.01/BG505 chimera | SOS-DS-10ln-HATM | | |
| 1798 | T063 | 16055-2.3-chim_SOS-DS-10ln-HATM | 16055-2.3/BG505 chimera | SOS-DS-10ln-HATM | | |
| 1799 | T064 | ZM55.28a-chim_SOS-DS-10ln-HATM | ZM55.28a/BG505 chimera | SOS-DS-10ln-HATM | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1800 | T065 | CH117.4-chim_SOS-DS-101n-HATM | CH117.4/BG505 chimera | SOS-DS-101n-HATM | | |
| 1801 | T066 | CNE58-chim_SOS-DS-101n-HATM | CNE58/BG505 chimera | SOS-DS-101n-HATM | | |
| 1802 | T067 | ZM53.12-chim_SOS-DS-101n-HATM | ZM53.12/BG505 chimera | SOS-DS-101n-HATM | | |
| 1803 | T068 | ZM197.7-chim_SOS-DS-101n-HATM | ZM197.7/BG505 chimera | SOS-DS-101n-HATM | | |
| 1804 | T069 | 25925-2.22-chim_SOS-DS-101n-HATM | 25925-2.22/BG505 chimera | SOS-DS-101n-HATM | | |
| 1805 | T070 | ZM106.9-chim_SOS-DS-MPER-TM | ZM106.9/BG505 chimera | SOS-DS-MPER-TM | | |
| 1806 | T071 | AC10.29-chim_SOS-DS-MPER-TM | AC10.29/BG505 chimera | SOS-DS-MPER-TM | | |
| 1807 | T072 | CH038.12-chim_SOS-DS-MPER-TM | CH038.12/BG505 chimera | SOS-DS-MPER-TM | | |
| 1808 | T073 | TRO.11-chim_SOS-DS-MPER-TM | TRO.11/BG505 chimera | SOS-DS-MPER-TM | | |
| 1809 | T074 | QH209.14M.A2-chimSOS-DS-MPER-TM | QH209.14M.A2/BG505 chimera | SOS-DS-MPER-TM | | |
| 1810 | T075 | 6545.V4.C1-chim_SOS-DS-MPER-TM | 6545.V4.C1/BG505 chimera | SOS-DS-MPER-TM | | |
| 1811 | T076 | KER2018.11-chim_SOS-DS-MPER-TM | KER2018.11/BG505 chimera | SOS-DS-MPER-TM | | |
| 1812 | T077 | MB201.A1-chim_SOS-DS-MPER-TM | MB201.A1/BG505 chimera | SOS-DS-MPER-TM | | |
| 1813 | T078 | B1369.9A-chim_SOS-DS-MPER-TM | B1369.9A/BG505 chimera | SOS-DS-MPER-TM | | |
| 1814 | T079 | CNE55-chim_SOS-DS-MPER-TM | CNE55/BG505 chimera | SOS-DS-MPER-TM | | |
| 1815 | T080 | TH966.8-chim_SOS-DS-MPER-TM | TH966.8/BG505 chimera | SOS-DS-MPER-TM | | |

-continued

| SEQ ID NO | Code | Name | Native Background | Mutations Compared to Native Background | Additional mutations | Comment |
|---|---|---|---|---|---|---|
| 1816 | T081 | R2184.c4-chim_SOS-DS-MPER-TM | R2184.c4/BG505 chimera | SOS-DS-MPER-TM | | |
| 1817 | T082 | DU422.01-chim_SOS-DS-MPER-TM | DU422.01/BG505 chimera | SOS-DS-MPER-TM | | |
| 1818 | T083 | 16055-2.3-chim_SOS-DS-MPER-TM | 16055-2.3/BG505 chimera | SOS-DS-MPER-TM | | |
| 1819 | T084 | ZM55.28a-chim_SOS-DS-MPER-TM | ZM55.28a/BG505 chimera | SOS-DS-MPER-TM | | |
| 1820 | T085 | CH117.4-chim_SOS-DS-MPER-TM | CH117.4/BG505 chimera | SOS-DS-MPER-TM | | |
| 1821 | T086 | CNE58-chim_SOS-DS-MPER-TM | CNE58/BG505 chimera | SOS-DS-MPER-TM | | |
| 1822 | T087 | ZM53.12-chim_SOS-DS-MPER-TM | ZM53.12/BG505 chimera | SOS-DS-MPER-TM | | |
| 1823 | T088 | ZM197.7-chim_SOS-DS-MPER-TM | ZM197.7/BG505 chimera | SOS-DS-MPER-TM | | |
| 1824 | T089 | 25925-2.22-chim_SOS-DS-MPER-TM | 25925-2.22/BG505 chimera | SOS-DS-MPER-TM | | |
| 1825 | T090 | ZM106.9-chim_SOS-DS-MPER-TM-cyto | ZM106.9/BG505 chimera | SOS-DS-MPER-TM-cyto | | |
| 1826 | T091 | AC10.29-chim_SOS-DS-MPER-TM-cyto | AC10.29/BG505 chimera | SOS-DS-MPER-TM-cyto | | |
| 1827 | T092 | CH038.12-chim_SOS-DS-MPER-TM-cyto | CH038.12/BG505 chimera | SOS-DS-MPER-TM-cyto | | |
| 1828 | T093 | TRO.11-chim_SOS-DS-MPER-TM-cyto | TRO.11/BG505 chimera | SOS-DS-MPER-TM-cyto | | |
| 1829 | T094 | QH209.14M.A2-chim_SOS-DS-MPER-TM-cyto | QH209.14M.A2/BG505 chimera | SOS-DS-MPER-TM-cyto | | |
| 1830 | T095 | 6545.V4.C1-chim_SOS-DS-MPER-TM-cyto | 6545.V4.C1/BG505 chimera | SOS-DS-MPER-TM-cyto | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1831 | T096 | KER2018.11-chim_SOS-DS-MPER-TM-cyto | KER2018.11/BG505 chimera | SOS-DS-MPER-TM-cyto | | |
| 1832 | T097 | MB201.A1-chim_SOS-DS-MPER-TM-cyto | MB201.A1/BG505 chimera | SOS-DS-MPER-TM-cyto | | |
| 1833 | T098 | B1369.9A-chim_SOS-DS-MPER-TM-cyto | B1369.9A/BG505 chimera | SOS-DS-MPER-TM-cyto | | |
| 1834 | T099 | CNE55-chim_SOS-DS-MPER-TM-cyto | CNE55/BG505 chimera | SOS-DS-MPER-TM-cyto | | |
| 1835 | T100 | TH966.8-chim_SOS-DS-MPER-TM-cyto | TH966.8/BG505 chimera | SOS-DS-MPER-TM-cyto | | |
| 1836 | T101 | R2184.c4-chim_SOS-DS-MPER-TM-cyto | R2184.c4/BG505 chimera | SOS-DS-MPER-TM-cyto | | |
| 1837 | T102 | DU422.01-chim_SOS-DS-MPER-TM-cyto | DU422.01/BG505 chimera | SOS-DS-MPER-TM-cyto | | |
| 1838 | T103 | 16055-2.3-chim_SOS-DS-MPER-TM-cyto | 16055-2.3/BG505 chimera | SOS-DS-MPER-TM-cyto | | |
| 1839 | T104 | ZM55.28a-chim_SOS-DS-MPER-TM-cyto | ZM55.28a/BG505 chimera | SOS-DS-MPER-TM-cyto | | |
| 1840 | T105 | CH117.4-chim_SOS-DS-MPER-TM-cyto | CH117.4/BG505 chimera | SOS-DS-MPER-TM-cyto | | |
| 1841 | T106 | CNE58-chim_SOS-DS-MPER-TM-cyto | CNE58/BG505 chimera | SOS-DS-MPER-TM-cyto | | |
| 1842 | T107 | ZM53.12-chim_SOS-DS-MPER-TM-cyto | ZM53.12/BG505 chimera | SOS-DS-MPER-TM-cyto | | |
| 1843 | T108 | ZM197.7-chim_SOS-DS-MPER-TM-cyto | ZM197.7/BG505 chimera | SOS-DS-MPER-TM-cyto | | |
| 1844 | T109 | 25925-2.22-chim_SOS-DS-MPER-TM-cyto | 25925-2.22/BG505 chimera | SOS-DS-MPER-TM-cyto | | |
| 1845 | T110 | AC10.29-chim_sc10ln-IP-10ln-HATM | AC10.29/BG505 chimera | sc10ln-IP-10ln-HATM | | |
| 1846 | T111 | CH038.12-chim_sc10ln-IP-10ln-HATM | CH038.12/BG505 chimera | sc10ln-IP-10ln-HATM | | |

-continued

| SEQ ID NO | Code | Name | Native Background | Mutations Compared to Native Background | Additional mutations | Comment |
|---|---|---|---|---|---|---|
| 1847 | T112 | TRO.11-chim_sc10ln-IP-10ln-HATM | TRO.11/BG505 chimera | sc10ln-IP-10ln-HATM | | |
| 1848 | T113 | QH209.14M.A2-chimsc10ln-IP-10ln-HATM | QH209.14M.A2/BG505 chimera | sc10ln-IP-10ln-HATM | | |
| 1849 | T114 | KER2018.11-chim_sc10ln-IP-10ln-HATM | KER2018.11/BG505 chimera | sc10ln-IP-10ln-HATM | | |
| 1850 | T115 | MB201.A1-chim_sc10ln-IP-10ln-HATM | MB201.A1/BG505 chimera | sc10ln-IP-10ln-HATM | | |
| 1851 | T116 | ZM55.28a-chim_sc10ln-IP-10ln-HATM | ZM55.28a/BG505 chimera | sc10ln-IP-10ln-HATM | | |
| 1852 | T117 | CH117.4-chim_sc10ln-IP-10ln-HATM | CH117.

-continued

| SEQ ID NO | Code | Name | Native Background | Mutations Compared to Native Background | Additional mutations | Comment |
|---|---|---|---|---|---|---|
| 1862 | T127 | CNE55-chim_sc10ln-IP-MPER-TM | CNE55/BG505 chimera | sc10ln-IP-MPER-TM | | |
| 1863 | T128 | DU422.01-chim_sc10ln-IP-MPER-TM | DU422.01/BG505 chimera | sc10ln-IP-MPER-TM | | |
| 1864 | T129 | CH117.4-chim_sc10ln-IP-MPER-TM | CH117.4/BG505 chimera | sc10ln-IP-MPER-TM | | |
| 1865 | T130 | CNE58-chim_sc10ln-IP-MPER-TM | CNE58/BG505 chimera | sc10ln-IP-MPER-TM | | |
| 1866 | T131 | 25925-2.22-chim_sc10ln-IP-MPER-TM | 25925-2.22/BG505 chimera | sc10ln-IP-MPER-TM | | |
| 1867 | T132 | ZM106.9-chim_sc10ln-IP-MPER-TM-cyto | ZM106.9/BG505 chimera | sc10ln-IP-MPER-TM-cyto | | |
| 1868 | T133 | AC10.29-chim_sc10ln-IP-MPER-TM-cyto | AC10.29/BG505 chimera | sc10ln-IP-MPER-TM-cyto | | |
| 1869 | T134 | CH038.12-chim_sc10ln-IP-MPER-TM-cyto | CH038.12/BG505 chimera | sc10ln-IP-MPER-TM-cyto | | |
| 1870 | T135 | TRO.11-chim_sc10ln-IP-MPER-TM-cyto | TRO.11/BG505 chimera | sc10ln-IP-MPER-TM-cyto | | |
| 1871 | T136 | QH209.14M.A2-chim_sc10ln-IP-MPER-TM-cyto | QH209.14M.A2/BG505 chimera | sc10ln-IP-MPER-TM-cyto | | |
| 1872 | T137 | 6545.V4.C1-chim_sc10ln-IP-MPER-TM-cyto | 6545.V4.C1/BG505 chimera | sc10ln-IP-MPER-TM-cyto | | |
| 1873 | T138 | KER2018.11-chim_sc10ln-IP-MPER-TM-cyto | KER2018.11/BG505 chimera | sc10ln-IP-MPER-TM-cyto | | |
| 1874 | T139 | MB201.A1-chim_sc10ln-IP-MPER-TM-cyto | MB201.A1/BG505 chimera | sc10ln-IP-MPER-TM-cyto | | |
| 1875 | T140 | B1369.9A-chim_sc10ln-IP-MPER-TM-cyto | B1369.9A/BG505 chimera | sc10ln-IP-MPER-TM-cyto | | |
| 1876 | T141 | CNE55-chim_sc10ln-IP-MPER-TM-cyto | CNE55/BG505 chimera | sc10ln-IP-MPER-TM-cyto | | |
| 1877 | T142 | TH966.8-chim_sc10ln-IP-MPER-TM-cyto | TH966.8/BG505 chimera | sc10ln-IP-MPER-TM-cyto | | |

-continued

| SEQ ID NO | Code | Name | Native Background | Mutations Compared to Native Background | Additional mutations | Comment |
|---|---|---|---|---|---|---|
| 1878 | T143 | R2184.c4-chim_sc101n-IP-MPER-TM-cyto | R2184.c4/BG505 chimera | sc101n-IP-MPER-TM-cyto | | |
| 1879 | T144 | DU422.01-chim_sc101n-IP-MPER-TM-cyto | DU422.01/BG505 chimera | sc101n-IP-MPER-TM-cyto | | |
| 1880 | T145 | 16055-2.3-chim_sc101n-IP-MPER-TM-cyto | 16055-2.3/BG505 chimera | sc101n-IP-MPER-TM-cyto | | |
| 1881 | T146 | ZM55.28a-chim_sc101n-IP-MPER-TM-cyto | ZM55.28a/BG505 chimera | sc101n-IP-MPER-TM-cyto | | |
| 1882 | T147 | CH117.4-chim_sc101n-IP-MPER-TM-cyto | CH117.4/BG505 chimera | sc101n-IP-MPER-TM-cyto | | |
| 1883 | T148 | CNE58-chim_sc101n-IP-MPER-TM-cyto | CNE58/BG505 chimera | sc101n-IP-MPER-TM-cyto | | |
| 1884 | T149 | ZM53.12-chim_sc101n-IP-MPER-TM-cyto | ZM53.12/BG505 chimera | sc101n-IP-MPER-TM-cyto | | |
| 1885 | T150 | ZM197.7-chim_sc101n-IP-MPER-TM-cyto | ZM197.7/BG505 chimera | sc101n-IP-MPER-TM-cyto | | |
| 1886 | T151 | 25925-2.22-chim_sc101n-IP-MPER-TM-cyto | 25925-2.22/BG505 chimera | sc101n-IP-MPER-TM-cyto | | |
| 1887 | T152 | ZM106.9-chim_sc151n-SOS-DS-101n-HATM | ZM106.9/BG505 chimera | sc151n-SOS-DS-101n-HATM | | |
| 1888 | T153 | AC10.29-chim_sc151n-SOS-DS-101n-HATM | AC10.29/BG505 chimera | sc151n-SOS-DS-101n-HATM | | |
| 1889 | T154 | CH038.12-chim_sc151n-SOS-DS-101n-HATM | CH038.12/BG505 chimera | sc151n-SOS-DS-101n-HATM | | |
| 1890 | T155 | TRO.11-chim_sc151n-SOS-DS-101n-HATM | TRO.11/BG505 chimera | sc151n-SOS-DS-101n-HATM | | |
| 1891 | T156 | QH209.14M.A2-chim_sc151n-SOS-DS-101n-HATM | QH209.14M.A2/BG505 chimera | sc151n-SOS-DS-101n-HATM | | |
| 1892 | T157 | 6545.V4.C1-chim_sc151n-SOS-DS-101n-HATM | 6545.V4.C1/BG505 chimera | sc151n-SOS-DS-101n-HATM | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1893 | T158 | KER2018.11-chim_sc15ln-SOS-DS-101n-HATM | KER2018.11/BG505 chimera | sc15ln-SOS-DS-101n-HATM | | |
| 1894 | T159 | MB201.A1-chim_sc15ln-SOS-DS-101n-HATM | MB201.A1/BG505 chimera | sc15ln-SOS-DS-101n-HATM | | |
| 1895 | T160 | B1369.9A-chim_sc15ln-SOS-DS-101n-HATM | B1369.9A/BG505 chimera | sc15ln-SOS-DS-101n-HATM | | |
| 1896 | T161 | CNE55-chim_sc15ln-SOS-DS-101n-HATM | CNE55/BG505 chimera | sc15ln-SOS-DS-101n-HATM | | |
| 1897 | T162 | TH966.8-chim_sc15ln-SOS-DS-101n-HATM | TH966.8/BG505 chimera | sc15ln-SOS-DS-101n-HATM | | |
| 1898 | T163 | R2184.c4-chim_sc15ln-SOS-DS-101n-HATM | R2184.c4/BG505 chimera | sc15ln-SOS-DS-101n-HATM | | |
| 1899 | T164 | DU422.01-chim_sc15ln-SOS-DS-101n-HATM | DU422.01/BG505 chimera | sc15ln-SOS-DS-101n-HATM | | |
| 1900 | T165 | 16055-2.3-chim_sc15ln-SOS-DS-101n-HATM | 16055-2.3/BG505 chimera | sc15ln-SOS-DS-101n-HATM | | |
| 1901 | T166 | CH117.4-chim_sc15ln-SOS-DS-101n-HATM | CH117.4/BG505 chimera | sc15ln-SOS-DS-101n-HATM | | |
| 1902 | T167 | CNE58-chim_sc15ln-SOS-DS-101n-HATM | CNE58/BG505 chimera | sc15ln-SOS-DS-101n-HATM | | |
| 1903 | T168 | ZM53.12-chim_sc15ln-SOS-DS-101n-HATM | ZM53.12/BG505 chimera | sc15ln-SOS-DS-101n-HATM | | |
| 1904 | T169 | ZM197.7-chim_sc15ln-SOS-DS-101n-HATM | ZM197.7/BG505 chimera | sc15ln-SOS-DS-101n-HATM | | |
| 1905 | T170 | 25925-2.22-chim_sc15ln-SOS-DS-101n-HATM | 25925-2.22/BG505 chimera | sc15ln-SOS-DS-101n-HATM | | |
| 1906 | T171 | ZM106.9-chim_sc15ln-SOS-DS-MPER-TM | ZM106.9/BG505 chimera | sc15ln-SOS-DS-MPER-TM | | |
| 1907 | T172 | AC10.29-chim_sc15ln-SOS-DS-MPER-TM | AC10.29/BG505 chimera | sc15ln-SOS-DS-MPER-TM | | |
| 1908 | T173 | CH038.12-chim_sc15ln-SOS-DS-MPER-TM | CH038.12/BG505 chimera | sc15ln-SOS-DS-MPER-TM | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1909 | T174 | TRO.11-chim_sc15ln-SOS-DS-MPER-TM | TRO.11/BG505 chimera | sc15ln-SOS-DS-MPER-TM | | |
| 1910 | T175 | QH209.14M.A2-chim_sc15ln-SOS-DS-MPER-TM | QH209.14M.A2/BG505 chimera | sc15ln-SOS-DS-MPER-TM | | |
| 1911 | T176 | 6545.V4.C1-chim_sc15ln-SOS-DS-MPER-TM | 6545.V4.C1/BG505 chimera | sc15ln-SOS-DS-MPER-TM | | |
| 1912 | T177 | KER2018.11-chim_sc15ln-SOS-DS-MPER-TM | KER2018.11/BG505 chimera | sc15ln-SOS-DS-MPER-TM | | |
| 1913 | T178 | MB201.A1-chim_sc15ln-SOS-DS-MPER-TM | MB201.A1/BG505 chimera | sc15ln-SOS-DS-MPER-TM | | |
| 1914 | T179 | B1369.9A-chim_sc15ln-SOS-DS-MPER-TM | B1369.9A/BG505 chimera | sc15ln-SOS-DS-MPER-TM | | |
| 1915 | T180 | CNE55-chim_sc15ln-SOS-DS-MPER-TM | CNE55/BG505 chimera | sc15ln-SOS-DS-MPER-TM | | |
| 1916 | T181 | TH966.8-chim_sc15ln-SOS-DS-MPER-TM | TH966.8/BG505 chimera | sc15ln-SOS-DS-MPER-TM | | |
| 1917 | T182 | _sc15ln-SOS-DS-MPER-TM | R2184.c4/BG505 chimera | sc15ln-SOS-DS-MPER-TM | | |
| 1918 | T183 | DU422.01-chim_sc15ln-SOS-DS-MPER-TM | DU422.01/BG505 chimera | sc15ln-SOS-DS-MPER-TM | | |
| 1919 | T184 | 16055-2.3-chim_sc15ln-SOS-DS-MPER-TM | 16055-2.3/BG505 chimera | sc15ln-SOS-DS-MPER-TM | | |
| 1920 | T185 | ZM55.28a-chim_sc15ln-SOS-DS-MPER-TM | ZM55.28a/BG505 chimera | sc15ln-SOS-DS-MPER-TM | | |
| 1921 | T186 | CH117.4-chim_sc15ln-SOS-DS-MPER-TM | CH117.4/BG505 chimera | sc15ln-SOS-DS-MPER-TM | | |
| 1922 | T187 | CNE58-chim_sc15ln-SOS-DS-MPER-TM | CNE58/BG505 chimera | sc15ln-SOS-DS-MPER-TM | | |
| 1923 | T188 | ZM53.12-chim_sc15ln-SOS-DS-MPER-TM | ZM53.12/BG505 chimera | sc15ln-SOS-DS-MPER-TM | | |
| 1924 | T189 | ZM197.7-chim_sc15ln-SOS-DS-MPER-TM | ZM197.7/BG505 chimera | sc15ln-SOS-DS-MPER-TM | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1925 | T190 | 25925-2.22-chim_sc15ln-SOS-DS-MPER-TM | 25925-2.22/BG505 chimera | sc15ln-SOS-DS-MPER-TM | | |
| 1926 | T191 | ZM106.9-chim_sc15ln-SOS-DS-MPER-TM-cyto | ZM106.9/BG505 chimera | sc15ln-SOS-DS-MPER-TM-cyto | | |
| 1927 | T192 | AC10.29-chim_sc15ln-SOS-DS-MPER-TM-cyto | AC10.29/BG505 chimera | sc15ln-SOS-DS-MPER-TM-cyto | | |
| 1928 | T193 | CH038.12-chim_sc15ln-SOS-DS-MPER-TM-cyto | CH038.12/BG505 chimera | sc15ln-SOS-DS-MPER-TM-cyto | | |
| 1929 | T194 | TRO.11-chim_sc15ln-SOS-DS-MPER-TM-cyto | TRO.11/BG505 chimera | sc15ln-SOS-DS-MPER-TM-cyto | | |
| 1930 | T195 | QH209.14M.A2-chim_sc15ln-SOS-DS-MPER-TM-cyto | QH209.14M.A2/BG505 chimera | sc15ln-SOS-DS-MPER-TM-cyto | | |
| 1931 | T196 | 6545.V4.C1-chim_sc15ln-SOS-DS-MPER-TM-cyto | 6545.V4.C1/BG505 chimera | sc15ln-SOS-DS-MPER-TM-cyto | | |
| 1932 | T197 | KER2018.11-chim_sc15ln-SOS-DS-MPER-TM-cyto | KER2018.11/BG505 chimera | sc15ln-SOS-DS-MPER-TM-cyto | | |
| 1933 | T198 | MB201.A1-chim_sc15ln-SOS-DS-MPER-TM-cyto | MB201.A1/BG505 chimera | sc15ln-SOS-DS-MPER-TM-cyto | | |
| 1934 | T199 | B1369.9A-chim_sc15ln-SOS-DS-MPER-TM-cyto | B1369.9A/BG505 chimera | sc15ln-SOS-DS-MPER-TM-cyto | | |
| 1935 | T200 | CNE55-chim_sc15ln-SOS-DS-MPER-TM-cyto | CNE55/BG505 chimera | sc15ln-SOS-DS-MPER-TM-cyto | | |
| 1936 | T201 | TH966.8-chim_sc15ln-SOS-DS-MPER-TM-cyto | TH966.8/BG505 chimera | sc15ln-SOS-DS-MPER-TM-cyto | | |
| 1937 | T202 | R2184.c4-chim_sc15ln-SOS-DS-MPER-TM-cyto | R2184.c4/BG505 chimera | sc15ln-SOS-DS-MPER-TM-cyto | | |
| 1938 | T203 | DU422.01-chim_sc15ln-SOS-DS-MPER-TM-cyto | DU422.01/BG505 chimera | sc15ln-SOS-DS-MPER-TM-cyto | | |
| 1939 | T204 | 16055-2.3-chim_sc15ln-SOS-DS-MPER-TM-cyto | 16055-2.3/BG505 chimera | sc15ln-SOS-DS-MPER-TM-cyto | | |
| 1940 | T205 | ZM55.28a-chim_sc15ln-SOS-DS-MPER-TM-cyto | ZM55.28a/BG505 chimera | sc15ln-SOS-DS-MPER-TM-cyto | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1941 | T206 | CH117.4-chim_sc15ln-SOS-DS-MPER-TM-cyto | CH117.4/BG505 chimera | sc15ln-SOS-DS-MPER-TM-cyto | | |
| 1942 | T207 | CNE58-chim_sc15ln-SOS-DS-MPER-TM-cyto | CNE58/BG505 chimera | sc15ln-SOS-DS-MPER-TM-cyto | | |
| 1943 | T208 | ZM53.12-chim_sc15ln-SOS-DS-MPER-TM-cyto | ZM53.12/BG505 chimera | sc15ln-SOS-DS-MPER-TM-cyto | | |
| 1944 | T209 | ZM197.7-chim_sc15ln-SOS-DS-MPER-TM-cyto | ZM197.7/BG505 chimera | sc15ln-SOS-DS-MPER-TM-cyto | | |
| 1945 | T210 | 25925-2.22-chim_sc15ln-SOS-DS-MPER-TM-cyto | 25925-2.22/BG505 chimera | sc15ln-SOS-DS-MPER-TM-cyto | | |
| 1946 | T211 | ZM106.9-chim_IP-DS-10ln-HATM | ZM106.9/BG505 chimera | IP-DS-10ln-HATM | | |
| 1947 | T212 | AC10.29-chim_IP-DS-10ln-HATM | AC10.29/BG505 chimera | IP-DS-10ln-HATM | | |
| 1948 | T213 | CH038.12-chim_IP-DS-10ln-HATM | CH038.12/BG505 chimera | IP-DS-10ln-HATM | | |
| 1949 | T214 | TRO.11-chim_IP-DS-10ln-HATM | TRO.11/BG505 chimera | IP-DS-10ln-HATM | | |
| 1950 | T215 | QH209.14M.A2-chimIP-DS-10ln-HATM | QH209.14M.A2/BG505 chimera | IP-DS-10ln-HATM | | |
| 1951 | T216 | 6545.V4.C1-chim_IP-DS-10ln-HATM | 6545.V4.C1/BG505 chimera | IP-DS-10ln-HATM | | |
| 1952 | T217 | KER2018.11-chim_IP-DS-10ln-HATM | KER2018.11/BG505 chimera | IP-DS-10ln-HATM | | |
| 1953 | T218 | MB201.A1-chim_IP-DS-10ln-HATM | MB201.A1/BG505 chimera | IP-DS-10ln-HATM | | |
| 1954 | T219 | B1369.9A-chim_IP-DS-10ln-HATM | B1369.9A/BG505 chimera | IP-DS-10ln-HATM | | |
| 1955 | T220 | CNE55-chim_IP-DS-10ln-HATM | CNE55/BG505 chimera | IP-DS-10ln-HATM | | |

TABLE-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1956 | T221 | TH966.8-chim_IP-DS-101n-HATM | TH966.8/BG505 chimera | IP-DS-101n-HATM | | |
| 1957 | T222 | R2184.c4-chim_IP-DS-101n-HATM | R2184.c4/BG505 chimera | IP-DS-101n-HATM | | |
| 1958 | T223 | DU422.01-chim_IP-DS-101n-HATM | DU422.01/BG505 chimera | IP-DS-101n-HATM | | |
| 1959 | T224 | 16055-2.3-chim_IP-DS-101n-HATM | 16055-2.3/BG505 chimera | IP-DS-101n-HATM | | |
| 1960 | T225 | ZM55.28a-chim_IP-DS-101n-HATM | ZM55.28a/BG505 chimera | IP-DS-101n-HATM | | |
| 1961 | T226 | CH117.4-chim_IP-DS-101n-HATM | CH117.4/BG505 chimera | IP-DS-101n-HATM | | |
| 1962 | T227 | CNE58-chim_IP-DS-101n-HATM | CNE58/BG505 chimera | IP-DS-101n-HATM | | |
| 1963 | T228 | ZM53.12-chim_IP-DS-101n-HATM | ZM53.12/BG505 chimera | IP-DS-101n-HATM | | |
| 1964 | T229 | ZM197.7-chim_IP-DS-101n-HATM | ZM197.7/BG505 chimera | IP-DS-101n-HATM | | |
| 1965 | T230 | 25925-2.22-chim_IP-DS-101n-HATM | 25925-2.22/BG505 chimera | IP-DS-101n-HATM | | |
| 1966 | T231 | ZM106.9-chim_IP-DS-MPER-TM | ZM106.9/BG505 chimera | IP-DS-MPER-TM | | |
| 1967 | T232 | AC10.29-chim_IP-DS-MPER-TM | AC10.29/BG505 chimera | IP-DS-MPER-TM | | |
| 1968 | T233 | CH038.12-chim_IP-DS-MPER-TM | CH038.12/BG505 chimera | IP-DS-MPER-TM | | |
| 1969 | T234 | TRO.11-chim_IP-DS-MPER-TM | TRO.11/BG505 chimera | IP-DS-MPER-TM | | |
| 1970 | T235 | QH209.14M.A2-chim_IP-DS-MPER-TM | QH209.14M.A2/BG505 chimera | IP-DS-MPER-TM | | |
| 1971 | T236 | 6545.V4.C1-chim_IP-DS-MPER-TM | 6545.V4.C1/BG505 chimera | IP-DS-MPER-TM | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1972 | T237 | KER2018.11-chim_IP-DS-MPER-TM | KER2018.11/BG505 chimera | IP-DS-MPER-TM | | |
| 1973 | T238 | MB201.A1-chim_IP-DS-MPER-TM | MB201.A1/BG505 chimera | IP-DS-MPER-TM | | |
| 1974 | T239 | B1369.9A-chim_IP-DS-MPER-TM | B1369.9A/BG505 chimera | IP-DS-MPER-TM | | |
| 1975 | T240 | CNE55-chim_IP-DS-MPER-TM | CNE55/BG505 chimera | IP-DS-MPER-TM | | |
| 1976 | T241 | TH966.8-chim_IP-DS-MPER-TM | TH966.8/BG505 chimera | IP-DS-MPER-TM | | |
| 1977 | T242 | R2184.c4-chim_IP-DS-MPER-TM | R2184.c4/BG505 chimera | IP-DS-MPER-TM | | |
| 1978 | T243 | DU422.01-chim_IP-DS-MPER-TM | DU422.01/BG505 chimera | IP-DS-MPER-TM | | |
| 1979 | T244 | 16055-2.3-chim_IP-DS-MPER-TM | 16055-2.3/BG505 chimera | IP-DS-MPER-TM | | |
| 1980 | T245 | ZM55.28a-chim_IP-DS-MPER-TM | ZM55.28a/BG505 chimera | IP-DS-MPER-TM | | |
| 1981 | T246 | CH117.4-chim_IP-DS-MPER-TM | CH117.4/BG505 chimera | IP-DS-MPER-TM | | |
| 1982 | T247 | CNE58-chim_IP-DS-MPER-TM | CNE58/BG505 chimera | IP-DS-MPER-TM | | |
| 1983 | T248 | ZM53.12-chim_IP-DS-MPER-TM | ZM53.12/BG505 chimera | IP-DS-MPER-TM | | |
| 1984 | T249 | ZM197.7-chim_IP-DS-MPER-TM | ZM197.7/BG505 chimera | IP-DS-MPER-TM | | |
| 1985 | T250 | 25925-2.22-chim_IP-DS-MPER-TM | 25925-2.22/BG505 chimera | IP-DS-MPER-TM | | |
| 1986 | T251 | ZM106.9-chim_IP-DS-MPER-TM-cyto | ZM106.9/BG505 chimera | IP-DS-MPER-TM-cyto | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 1987 | T252 | AC10.29-chim_IP-DS-MPER-TM-cyto | AC10.29/BG505 chimera | IP-DS-MPER-TM-cyto | | |
| 1988 | T253 | CH038.12-chim_IP-DS-MPER-TM-cyto | CH038.12/BG505 chimera | IP-DS-MPER-TM-cyto | | |
| 1989 | T254 | TRO.11-chim_IP-DS-MPER-TM-cyto | TRO.11/BG505 chimera | IP-DS-MPER-TM-cyto | | |
| 1990 | T255 | QH209.14M.A2-chim_IP-DS-MPER-TM-cyto | QH209.14M.A2/BG505 chimera | IP-DS-MPER-TM-cyto | | |
| 1991 | T256 | 6545.V4.C1-chim_IP-DS-MPER-TM-cyto | 6545.V4.C1/BG505 chimera | IP-DS-MPER-TM-cyto | | |
| 1992 | T257 | KER2018.11-chim_IP-DS-MPER-TM-cyto | KER2018.11/BG505 chimera | IP-DS-MPER-TM-cyto | | |
| 1993 | T258 | MB201.A1-chim_IP-DS-MPER-TM-cyto | MB201.A1/BG505 chimera | IP-DS-MPER-TM-cyto | | |
| 1994 | T259 | B1369.9A-chim_IP-DS-MPER-TM-cyto | B1369.9A/BG505 chimera | IP-DS-MPER-TM-cyto | | |
| 1995 | T260 | CNE55-chim_IP-DS-MPER-TM-cyto | CNE55/BG505 chimera | IP-DS-MPER-TM-cyto | | |
| 1996 | T261 | TH966.8-chim_IP-DS-MPER-TM-cyto | TH966.8/BG505 chimera | IP-DS-MPER-TM-cyto | | |
| 1997 | T262 | R2184.c4-chim_IP-DS-MPER-TM-cyto | R2184.c4/BG505 chimera | IP-DS-MPER-TM-cyto | | |
| 1998 | T263 | DU422.01-chim_IP-DS-MPER-TM-cyto | DU422.01/BG505 chimera | IP-DS-MPER-TM-cyto | | |
| 1999 | T264 | 16055-2.3-chim_SOS-DS-MPER-TM-cyto | 16055-2.3/BG505 chimera | SOS-DS-MPER-TM-cyto | | |
| 2000 | T265 | ZM55.28a-chim_SOS-DS-MPER-TM-cyto | ZM55.28a/BG505 chimera | SOS-DS-MPER-TM-cyto | | |
| 2001 | T266 | CH117.4-chim_SOS-DS-MPER-TM-cyto | CH117.4/BG505 chimera | SOS-DS-MPER-TM-cyto | | |
| 2002 | T267 | CNE58-chim_SOS-DS-MPER-TM-cyto | CNE58/BG505 chimera | SOS-DS-MPER-TM-cyto | | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 2003 | T268 | ZM53.12-chim_SOS-DS-MPER-TM-cyto | ZM53.12/BG505 chimera | SOS-DS-MPER-TM-cyto | | |
| 2004 | T269 | ZM197.7-chim_SOS-DS-MPER-TM-cyto | ZM197.7/BG505 chimera | SOS-DS-MPER-TM-cyto | | |
| 2005 | T270 | 25925-2.22-chim_SOS-DS-MPER-TM-cyto | 25925-2.22/ BG505 chimera | SOS-DS-MPER-TM-cyto | | |
| 2006 | T271 | TH966.8-chim_sc10ln-IP-MPER-TM-full-cytoplasmic domain | TH966.8/BG505 chimera | sc10ln-IP-MPER-TM-full-cytoplasmic domain | single-chain 10 amino acid replace cleavage site and I559P mutation | |
| 2007 | T272 | 6545.V4.C1-chim sc10ln-IP-MPER-TM-full-cytoplasmic domain | 6545.V4.C1/ BG505 chimera | sc10ln-IP-MPER-TM-full-cytoplasmic domain | single-chain 10 amino acid replace cleavage site and I559P mutation | |
| 2008 | T273 | cR2184.c4-chim_sc10ln-IP-MPER-TM-full-cytoplasmic domain | R2184.c4/BG505 chimera | sc10ln-IP-MPER-TM-full-cytoplasmic domain | single-chain 10 amino acid replace cleavage site and I559P mutation | |
| 2009 | T274 | ZM197.7-chim_sc10ln-IP-MPER-TM-full-cytoplasmic domain | ZM197.7/BG505 chimera | sc10ln-IP-MPER-TM-full-cytoplasmic domain | single-chain 10 amino acid replace cleavage site and I559P mutation | |
| 2010 | T275 | ZM106.9-chim_sc10ln-IP-MPER-TM-full-cytoplasmic domain | ZM106.9/BG505 chimera | sc10ln-IP-MPER-TM-full-cytoplasmic domain | single-chain 10 amino acid replace cleavage site and I559P mutation | |
| 2011 | T276 | ZM53.12-chim_sc10ln-IP-MPER-TM-full-cytoplasmic domain | ZM53.12/BG505 chimera | sc10ln-IP-MPER-TM-full-cytoplasmic domain | single-chain 10 amino acid replace cleavage site and I559P mutation | |
| 2012 | T277 | CNE55-chim_sc10ln-IP-MPER-TM-full-cytoplasmic domain | CNE55/BG505 chimera | sc10ln-IP-MPER-TM-full-cytoplasmic domain | single-chain 10 amino acid replace cleavage site and I559P mutation | |
| 2013 | T278 | DU422.01-chim_sc10ln-IP-MPER-TM-full-cytoplasmic domain | DU422.01/BG505 chimera | sc10ln-IP-MPER-TM-full-cytoplasmic domain | single-chain 10 amino acid replace cleavage site and I559P mutation | |
| 2014 | T279 | 25925-2.22-chim_sc10ln-IP-MPER-TM-full-cytoplasmic domain | 25925-2.22/ BG505 chimera | sc10ln-IP-MPER-TM-full-cytoplasmic domain | single-chain 10 amino acid replace cleavage site and I559P mutation | |
| 2015 | T280 | CNE58-chim_sc10ln-IP-MPER-TM-full-cytoplasmic domain | CNE58/BG505 chimera | sc10ln-IP-MPER-TM-full-cytoplasmic domain | single-chain 10 amino acid replace cleavage site and I559P mutation | |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 2016 | T281 | 16055-2.3-chim_sc101n-IP-MPER-TM-full-cytoplasmic domain | 16055-2.3/BG505 chimera | sc101n-IP-MPER-TM-full-cytoplasmic domain | single-chain 10 amino acid replace cleavage site and I559P mutation | |
| 2017 | T282 | ZM55.28a-chim_sc101n-IP-MPER-TM-full-cytoplasmic domain | ZM55.28a/BG505 chimera | sc101n-IP-MPER-TM-full-cytoplasmic domain | single-chain 10 amino acid replace cleavage site and I559P mutation | |
| 2018 | T283 | BI369.9A-chim_sc101n-IP-MPER-TM-full-cytoplasmic domain | BI369.9A/BG505 chimera | sc101n-IP-MPER-TM-full-cytoplasmic domain | single-chain 10 amino acid replace cleavage site and I559P mutation | |
| 2019 | T284 | TH966.8-chim_sc101n-a433p-IP-101n-HATM | TH966.8/BG505 chimera | sc101n-IP-101n-HATM | a433p | |
| 2020 | T285 | 6545.V4.C1-chim_sc101n-a433p-IP-101n-HATM | 6545.V4.C1/BG505 chimera | sc101n-IP-101n-HATM | a433p | |
| 2021 | T286 | R2184.c4-chim_sc101n-a433p-IP-101n-HATM | R2184.c4/BG505 chimera | sc101n-IP-101n-HATM | a433p | |
| 2022 | T287 | ZM197.7-chim_sc101n-a433p-IP-101n-HATM | ZM197.7/BG505 chimera | sc101n-IP-101n-HATM | a433p | |
| 2023 | T288 | ZM106.9-chim_sc101n-a433p-IP-101n-HATM | ZM106.9/BG505 chimera | sc101n-IP-101n-HATM | a433p | |
| 2024 | T289 | ZM53.12-chim_sc101n-a433p-IP-101n-HATM | ZM53.12/BG505 chimera | sc101n-IP-101n-HATM | a433p | |
| 2025 | T290 | R2184.c4-chim_sc101n-a433p-IP-MPER-TM | R2184.c4/BG505 chimera | sc101n-IP-MPER-TM | a433p | |
| 2026 | T291 | CNE55-chim_sc101n-a433p-IP-101n-HATM | CNE55/BG505 chimera | sc101n-IP-101n-HATM | a433p | |
| 2027 | T292 | 6545.V4.C1-chim_sc101In-a433p-IP-MPER-TM | 6545.V4.C1/BG505 chimera | sc101n-IP-MPER-TM | a433p | |
| 2028 | T293 | DU422.01-chim_sc101n-a433p-IP-101n-HATM | DU422.01/BG505 chimera | sc101n-IP-101n-HATM | a433p | |
| 2029 | T294 | 25925-2.22-chim_sc101n-a433p-IP-101n-HATM | 25925-2.22/BG505 chimera | sc101n-IP-101n-HATM | a433p | |

-continued

| SEQ ID NO | Code | Name | Native Background | Mutations Compared to Native Background | Additional mutations | Comment |
|---|---|---|---|---|---|---|
| 2030 | T295 | CNE58-chim_sc101n-a433p-IP-101n-HATM | CNE58/BG505 chimera | sc101n-IP-101n-HATM | a433p | |
| 2031 | T296 | 16055-2.3-chim_sc101n-a433p-IP-101n-HATM | 16055-2.3/BG505 chimera | sc101n-IP-101n-HATM | a433p | |
| 2032 | T297 | TH966.8-chim_sc101n-a433p-IP-MPER-TM | TH966.8/BG505 chimera | sc101n-IP-MPER-TM | a433p | |
| 2033 | T298 | ZM55.28a-chim_sc101n-a433p-IP-MPER-TM | ZM55.28a/BG505 chimera | sc101n-IP-MPER-TM | a433p | |
| 2034 | T299 | ZM53.12-chim_sc101n-a433p-IP-MPER-TM | ZM53.12/BG505 chimera | sc101n-IP-MPER-TM | a433p | |
| 2035 | T300 | B1369.9A-chim_sc101na433p--IP-101n-HATM | B1369.9A/BG505 chimera | sc101n-IP-101n-HATM | a433p | |
| 2036 | T301 | ZM197.7-chim_sc101n-a433p-IP-MPER-TM | ZM197.7/BG505 chimera | sc101n-IP-MPER-TM | a433p | |
| 2037 | T302 | 16055-2.3-chim_sc101n-a433p-IP-MPER-TM | 16055-2.3/BG505 chimera | sc101n-IP-MPER-TM | a433p | |
| 2038 | T303 | ZM55.28a-chim_sc15ln-SOS-a433p-101n-HATM | ZM55.28a/BG505 chimera | sc15ln-SOS-101n-HATM | a433p | |
| 2039 | T304 | TH966.8-chim_sc101n-IP-101n-HATM-173-yslfe-177 | TH966.8/BG505 chimera | sc101n-IP-101n-HATM | 173-177 mutated to YSLFE | Increase the negative charge in the V2 region to -continued

| 1 SEQ ID NO | 2 Code | 3 Name | 4 Native Background | 5 Mutations Compared to Native Background | 6 Additional mutations | 7 Comment |
|---|---|---|---|---|---|---|
| 2046 | T311 | CNE55-chim_sc101n-IP-101n-HATM-173-yslfe-177 | CNE55/BG505 chimera | sc101n-IP-101n-HATM | 173-177 mutated to YSLFE | Same as Seq_2039 |
| 2047 | T312 | 6545.V4.C1-chim_sc101n-IP-MPER-TM-173-yslfe-177 | 6545.V4.C1/BG505 chimera | sc101n-IP-MPER-TM | 173-177 mutated to YSLFE | Same as Seq_2039 |
| 2048 | T313 | DU422.01-chim_sc101n-IP-101n-HATM-173-yslfe-177 | DU422.01/BG505 chimera | sc101n-IP-101n-HATM | 173-177 mutated to YSLFE | Same as Seq_2039 |
| 2049 | T314 | 25925-2.22-chim_sc101n-IP-101n-HATM-173-yslfe-177 | 25925-2.22/BG505 chimera | sc101n-IP-101n-HATM | 173-177 mutated to YSLFE | Same as Seq_2039 |
| 2050 | T315 | CNE58-chim_sc101n-IP-101n-HATM-173-yslfe-177 | CNE58/BG505 chimera | sc101n-IP-101n-HATM | 173-177 mutated to YSLFE | Same as Seq_2039 |
| 2051 | T316 | 16055-2.3-chim_sc101n-IP-101n-HATM-173-yslfe-177 | 16055-2.3/BG505 chimera | sc101n-IP-101n-HATM | 173-177 mutated to YSLFE | Same as Seq_2039 |
| 2052 | T317 | TH966.8-chim_sc101n-IP-MPER-TM-173-yslfe-177 | TH966.8/BG505 chimera | sc101n-IP-MPER-TM | 173-177 mutated to YSLFE | Same as Seq_2039 |
| 2053 | T318 | ZM55.28a-chim_sc101n-IP-MPER-TM-173-yslfe-177 | ZM55.28a/BG505 chimera | sc101n-IP-MPER-TM | 173-177 mutated to YSLFE | Same as Seq_2039 |
| 2054 | T319 | ZM53.12-chim_sc101n-IP-MPER-TM-173-yslfe-177 | ZM53.12/BG505 chimera | sc101n-IP-MPER-TM | 173-177 mutated to YSLFE | Same as Seq_2039 |
| 2055 | T320 | B1369.9A-chim_sc101n-IP-101n-HATM-173-yslfe-177 | B1369.9A/BG505 chimera | sc101n-IP-101n-HATM | 173-177 mutated to YSLFE | Same as Seq_2039 |
| 2056 | T321 | ZM197.7-chim_sc101n-IP-MPER-TM-173-yslfe-177 | ZM197.7/BG505 chimera | sc101n-IP-MPER-TM | 173-177 mutated to YSLFE | Same as Seq_2039 |
| 2057 | T322 | 16055-2.3-chim_sc101n-IP-MPER-TM-173-yslfe-177 | 16055-2.3/BG505 chimera | sc101n-IP-MPER-TM | 173-177 mutated to YSLFE | Same as Seq_2039 |
| 2058 | T323 | ZM55.28a-chim_sc15ln-SOS-DS-101n-HATM-173-yslfe-177 | ZM55.28a/BG505 chimera | sc15ln-SOS-DS-101n-HATM | 173-177 mutated to YSLFE | Same as Seq_2039 |
| 2059 | T324 | TH966.8-chim_sc101n-IP-101n-HATM-173-eslfe-177 | TH966.8/BG505 chimera | sc101n-IP-101n-HATM | 173-177 mutated to ESLFE | Same as Seq_2039 |
| 2060 | T325 | 6545.V4.C1-chim_sc101n-IP-101n-HATM-173-eslfe-177 | 6545.V4.C1/BG505 chimera | sc101n-IP-101n-HATM | 173-177 mutated to ESLFE | Same as Seq_2039 |
| 2061 | T326 | R2184.c4-chim_sc101n-IP-101n-HATM-173-eslfe-177 | R2184.c4/BG505 chimera | sc101n-IP-101n-HATM | 173-177 mutated to ESLFE | Same as Seq_2039 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 2062 | T327 | ZM197.7-chim_sc101n-IP-10ln-HATM-173-eslfe-177 | ZM197.7/BG505 chimera | sc101n-IP-10ln-HATM | 173-177 mutated to ESLFE | Same as Seq_2039 |
| 2063 | T328 | ZM106.9-chim_sc101n-IP-10ln-HATM-173-eslfe-177 | ZM106.9/BG505 chimera | sc101n-IP-10ln-HATM | 173-177 mutated to ESLFE | Same as Seq_2039 |
| 2064 | T329 | ZM53.12-chim_sc101n-IP-10ln-HATM-173-eslfe-177 | ZM53.12/BG505 chimera | sc101n-IP-10ln-HATM | 173-177 mutated to ESLFE | Same as Seq_2039 |
| 2065 | T330 | R2184.c4-chim_sc101n-IP-MPER-TM-173-eslfe-177 | R2184.c4/BG505 chimera | sc101n-IP-10ln-HATM | 173-177 mutated to ESLFE | Same as Seq_2039 |
| 2066 | T331 | CNE55-chim_sc101n-IP-10ln-HATM-173-eslfe-177 | CNE55/BG505 chimera | sc101n-IP-10ln-HATM | 173-177 mutated to ESLFE | Same as Seq_2039 |
| 2067 | T332 | 6545.V4.C1-chim_sc101n-IP-MPER-TM-173-eslfe-177 | 6545.V4.C1/BG505 chimera | sc101n-IP-MPER-TM | 173-177 mutated to ESLFE | Same as Seq_2039 |
| 2068 | T333 | DU422.01-chim_sc101n-IP-10ln-HATM-173-eslfe-177 | DU422.01/BG505 chimera | sc101n-IP-10ln-HATM | 173-177 mutated to ESLFE | Same as Seq_2039 |
| 2069 | T334 | 25925-2.22-chim sc101n-IP-10ln-HATM-173-eslfe-177 | 25925-2.22/BG505 chimera | sc101n-IP-10ln-HATM | 173-177 mutated to ESLFE | Same as Seq_2039 |
| 2070 | T335 | CNE58-chim_sc101n-IP-10ln-HATM-173-eslfe-177 | CNE58/BG505 chimera | sc101n-IP-10ln-HATM | 173-177 mutated to ESLFE | Same as Seq_2039 |
| 2071 | T336 | 16055-2.3-chim_sc101n-IP-10ln-HATM-173-eslfe-177 | 16055-2.3/BG505 chimera | sc101n-IP-10ln-HATM | 173-177 mutated to ESLFE | Same as Seq_2039 |
| 2072 | T337 | TH966.8-chim_sc101n-IP-MPER-TM-173-eslfe-177 | TH966.8/BG505 chimera | sc101n-IP-MPER-TM | 173-177 mutated to ESLFE | Same as Seq_2039 |
| 2073 | T338 | ZM55.28a-chim_sc101n-IP-MPER-TM-173-eslfe-177 | ZM55.28a/BG505 chimera | sc101n-IP-MPER-TM | 173-177 mutated to ESLFE | Same as Seq_2039 |
| 2074 | T339 | ZM53.12-chim_sc101n-IP-MPER-TM-173-eslfe-177 | ZM53.12/BG505 chimera | sc101n-IP-MPER-TM | 173-177 mutated to ESLFE | Same as Seq_2039 |
| 2075 | T340 | B1369.9A-chim_sc101n-IP-10ln-HATM-173-eslfe-177 | B1369.9A/BG505 chimera | sc101n-IP-10ln-HATM | 173-177 mutated to ESLFE | Same as Seq_2039 |
| 2076 | T341 | ZM197.7-chim_sc101n-IP-MPER-TM-173-eslfe-177 | ZM197.7/BG505 chimera | sc101n-IP-MPER-TM | 173-177 mutated to ESLFE | Same as Seq_2039 |

-continued

| 1 SEQ ID NO | 2 Code | 3 Name | 4 Native Background | 5 Mutations Compared to Native Background | 6 Additional mutations | 7 Comment |
|---|---|---|---|---|---|---|
| 2077 | T342 | 16055-2.3-chim_sc101n-IP-MPER-TM-173-eslfe-177 | 16055-2.3/BG505 chimera | sc101n-IP-MPER-TM | 173-177 mutated to ESLFE | Same as Seq_2039 |
| 2078 | T343 | ZM55.28a-chim_sc15ln-SOS-DS-101n-HATM-173-eslfe-177 | ZM55.28a/BG505 chimera | sc15ln-SOS-DS-101n-HATM | 173-177 mutated to ESLFE | Same as Seq_2039 |
| 2079 | T344 | TH966.8-chim_sc101n-IP-101n-HATM-173-eslfy-177 | TH966.8/BG505 chimera | sc101n-IP-101n-HATM | 173-177 mutated to ESLFY | Same as Seq_2039 |
| 2080 | T345 | 6545.V4.C1-chim_sc101n-IP-101n-HATM-173-eslfy-177 | 6545.V4.C1/BG505 chimera | sc101n-IP-101n-HATM | 173-177 mutated to ESLFY | Same as Seq_2039 |
| 2081 | T346 | R2184.c4-chim_sc101n-IP-101n-HATM-173-eslfy-177 | R2184.c4/BG505 chimera | sc101n-IP-101n-HATM | 173-177 mutated to ESLFY | Same as Seq_2039 |
| 2082 | T347 | ZM197.7-chim_sc101n-IP-101n-HATM-173-eslfy-177 | ZM197.7/BG505 chimera | sc101n-IP-101n-HATM | 173-177 mutated to ESLFY | Same as Seq_2039 |
| 2083 | T348 | ZM106.9-chim_sc101n-IP-101n-HATM-173-eslfy-177 | ZM106.9/BG505 chimera | sc101n-IP-101n-HATM | 173-177 mutated to ESLFY | Same as Seq_2039 |
| 2084 | T349 | ZM53.12-chim_sc101n-IP-101n-HATM-173-eslfy-177 | ZM53.12/BG505 chimera | sc101n-IP-101n-HATM | 173-177 mutated to ESLFY | Same as Seq_2039 |
| 2085 | T350 | R2184.c4-chim_sc101n-IP-MPER-TM-173-eslfy-177 | R2184.c4/BG505 chimera | sc101n-IP-MPER-TM | 173-177 mutated to ESLFY | Same as Seq_2039 |
| 2086 | T351 | CNE55-chim_sc101n-IP-101n-HATM-173-eslfy-177 | CNE55/BG505 chimera | sc101n-IP-101n-HATM | 173-177 mutated to ESLFY | Same as Seq_2039 |
| 2087 | T352 | 6545.V4.C1-chim_sc101n-IP-MPER-TM-173-eslfy-177 | 6545.V4.C1/BG505 chimera | sc101n-IP-MPER-TM | 173-177 mutated to ESLFY | Same as Seq_2039 |
| 2088 | T353 | DU422.01-chim_sc101n-IP-101n-HATM-173-eslfy-177 | DU422.01/BG505 chimera | sc101n-IP-101n-HATM | 173-177 mutated to ESLFY | Same as Seq_2039 |
| 2089 | T354 | 25925-2.22-chim_sc101n-IP-101n-HATM-173-eslfy-177 | 25925-2.22/BG505 chimera | sc101n-IP-101n-HATM | 173-177 mutated to ESLFY | Same as Seq_2039 |
| 2090 | T355 | CNE58-chim_sc101n-IP-101n-HATM-173-eslfy-177 | CNE58/BG505 chimera | sc101n-IP-101n-HATM | 173-177 mutated to ESLFY | Same as Seq_2039 |
| 2091 | T356 | 16055-2.3-chim_sc101n-IP-101n-HATM-173-eslfy-177 | 16055-2.3/BG505 chimera | sc101n-IP-101n-HATM | 173-177 mutated to ESLFY | Same as Seq_2039 |
| 2092 | T357 | TH966.8-chim_sc101n-IP-MPER-TM-173-eslfy-177 | TH966.8/BG505 chimera | sc101n-IP-MPER-TM | 173-177 mutated to ESLFY | Same as Seq_2039 |

-continued

| 1<br>SEQ ID NO | 2<br>Code | 3<br>Name | 4<br>Native Background | 5<br>Mutations Compared to Native Background | 6<br>Additional mutations | 7<br>Comment |
|---|---|---|---|---|---|---|
| 2093 | T358 | ZM55.28a-chim_sc10ln-IP-MPER-TM-173-eslfy-177 | ZM55.28a/BG505 chimera | sc10ln-IP-MPER-TM | 173-177 mutated to ESLFY | Same as Seq_2039 |
| 2094 | T359 | ZM53.12-chim_sc10ln-IP-MPER-TM-173-eslfy-177 | ZM53.12/BG505 chimera | sc10ln-IP-MPER-TM | 173-177 mutated to ESLFY | Same as Seq_2039 |
| 2095 | T360 | B1369.9A-chim_sc10ln-IP-10ln-HATM-173-eslfy-177 | B1369.9A/BG505 chimera | sc10ln-IP-10ln-HATM | 173-177 mutated to ESLFY | Same as Seq_2039 |
| 2096 | T361 | ZM197.7-chim_sc10ln-IP-MPER-TM-173-eslfy-177 | ZM197.7/BG505 chimera | sc10ln-IP-MPER-TM | 173-177 mutated to ESLFY | Same as Seq_2039 |
| 2097 | T362 | 16055-2.3-chim_sc10ln-IP-MPER-TM-173-eslfy-177 | 16055-2.3/BG505 chimera | sc10

-continued

| SEQ ID NO | Code | Name | Native Background | Mutations Compared to Native Background | Additional mutations | Comment |
|---|---|---|---|---|---|---|
| 2115 | 0 | JRFL | JRFL | | | |
| 2116 | H474 | T2504.SOSIP.6R.201C433C | T2504.SOSIP.6R.201C433C | | | |
| 2117 | | bg505.sosip_c15ln.201C-433C | bg505.sosip_c15ln.201C-433C | | | |
| 2118 | | soluble CD4 (sCD4) | soluble CD4 (sCD4) | | | |
| 2119 | | BG505.SOSIP.R6.664.T332N_I201C/A433C (VRC4571) | BG505 DNA | | | |
| 2120 | | BG505 WT DNA | | | | |
| 2121 | H475 | *BG505.SOSIP.R6.664.T332N.D368R.V1V2.CAP256_SU | BG505 chimera | V1V2SOSIP; 664; R6; 201C, D368R, 433C, T332N | V1V2 Swap CAP256-SU | SOSIP, V1V2 swap, 201-422 disulfide stabilization, cd4 binding site KO, |
| 2122 | H476 | *BG505.SOSIP.R6.664.T332N.D368R.V1V2.66201.B42 | BG505 chimera | V1V2SOSIP; 664; R6; 201C, D368R, 433C, T332N | V1V2 Swap BB201.B42 | SOSIP, V1V2 swap, 201-422 disulfide stabilization, cd4 binding site KO, |
| 2123 | H477 | *BG505.SOSIP.R6.664.T332N.D368R.V1V2.KER2018.11 | BG505 chimera | V1V2SOSIP; 664; R6; 201C, D368R, 433C, T332N | V1V2 Swap KER2018.11 | SOSIP, V1V2 swap, 201-422 disulfide stabilization, cd4 binding site KO, |
| 2124 | H478 | *BG505.SOSIP.R6.664.T332N.D368R.V1V2.CH070.1 | BG505 chimera | V1V2SOSIP; 664; R6; 201C, D368R, 433C, T332N | V1V2 Swap CH070.1 | SOSIP, V1V2 swap, 201-422 disulfide stabilization, cd4 binding site KO, |
| 2125 | H479 | *BG505.SOSIP.R6.664.T332N.D368R.V1V2.ZM233.6 | BG505 chimera | V1V2SOSIP; 664; R6; 201C, D368R, 433C, T332N | V1V2 Swap ZM233.6 | SOSIP, V1V2 swap, 201-422 disulfide stabilization, cd4 binding site KO, |
| 2126 | H480 | *BG505.SOSIP.R6.664.T332N.D368R.V1V2.Q23 | BG505 chimera | V1V2SOSIP; 664; R6; 201C, D368R, 433C, T332N | V1V2 Swap Q23 | SOSIP, V1V2 swap, 201-422 disulfide stabilization, cd4 binding site KO, |
| 2127 | H481 | *BG505.SOSIP.R6.664.T332N.D368R.V1V2.A244 | BG505 chimera | V1V2SOSIP; 664; R6; 201C, D368R, 433C, T332N | V1V2 Swap A244 | SOSIP, V1V2 swap, 201-422 disulfide stabilization, cd4 binding site KO, |
| 2128 | H482 | *BG505.SOSIP.R6.664.T332N.D368R.V1V2.WITO | BG505 chimera | V1V2SOSIP; 664; R6; 201C, D368R, 433C, T332N | V1V2 Swap WITO | SOSIP, V1V2 swap, 201-422 disulfide stabilization, cd4 binding site KO, |

-continued

| SEQ ID NO | Code | Name | Native Background | Mutations Compared to Native Background | Additional mutations | Comment |
|---|---|---|---|---|---|---|
| 2129 | H483 | *BG505.SOSIP.R6.664.T332N.D368R.V1V2.T250.4 | BG505 chimera | V1V2SOSIP; 664; R6; 201C, D368R, 433C, T332N | V1V2 Swap T250.4 | SOSIP, V1V2 swap, 201-422 disulfide stabilization, cd4 binding site KO, |
| 2130 | H484 | *BG505.SOSIP.R6.664.T332N.D368R.V1V2.CAP256_SU.W34.77 | BG505 chimera | V1V2SOSIP; 664; R6; 201C, D368R, 433C, T332N | V1V2 Swap CAP256-SU.Week34.clone77 | SOSIP, V1V2 swap, 201-422 disulfide stabilization, cd4 binding site KO, |
| 2131 | H485 | *BG505.SOSIP.R6.664.T332N.D368R.V1V2.CAP256_SU.W34.80 | BG505 chimera | V1V2SOSIP; 664; R6; 201C, D368R, 433C, T332N | V1V2 Swap CAP256-SU.Week34.clone80 | SOSIP, V1V2 swap, 201-422 disulfide stabilization, cd4 binding site KO, |
| 2132 | H486 | *BG505.SOSIP.R6.664.T332N.D368R.V1V2.CAP256_SU.W34.781 | BG505 chimera | V1V2SOSIP; 664; R6; 201C, D368R, 433C, T332N | V1V2 Swap CAP256-SU.Week34.clone81 | SOSIP, V1V2 swap, 201-422 disulfide stabilization, cd4 binding site KO, |
| 2133 | H487 | *CNE58.SOSIP.R6.V1V2.CAP256_SU | CNE58/136505 chimera | V1V2SOSIP; 664; R6; 201C, 433C | V1V2 Swap CAP256-SU | SOSIP, V1V2 swap, 201-422 disulfide stabilization, on chimeric backbone |
| 2134 | H488 | *CNE58.SOSIP.R6.V1V2.BB201.1342 | CNE58/136505 chimera | V1V2SOSIP; 664; R6; 201C, 433C | V1V2 Swap BB201.1342 | SOSIP, V1V2 swap, 201-422 disulfide stabilization, on chimeric backbone |
| 2135 | H489 | *CNE58.SOSIP.R6.V1V2.KER2018.11 | CNE58/BG505 chimera | V1V2SOSIP; 664; R6; 201C, 433C | V1V2 Swap KER2018.11 | SOSIP, V1V2 swap, 201-422 disulfide stabilization, on chimeric backbone |
| 2136 | H490 | *CNE58.SOSIP.R6.V1V2.CH070.1 | CNE58/BG505 chimera | V1V2SOSIP; 664; R6; 201C, 433C | V1V2 Swap CH070.1 | SOSIP, V1V2 swap, 201-422 disulfide stabilization, on chimeric backbone |
| 2137 | H491 | *CNE58.SOSIP.R6.V1V2.ZM233.6 | CNE58/BG505 chimera | V1V2SOSIP; 664; R6; 201C, 433C | V1V2 Swap ZM233.6 | SOSIP, V1V2 swap, 201-422 disulfide stabilization, on chimeric backbone |
| 2138 | H492 | *CNE58.SOSIP.R6.V1V2.Q23 | CNE58/BG505 chimera | V1V2SOSIP; 664; R6; 201C, 433C | V1V2 Swap Q23 | SOSIP, V1V2 swap, 201-422 disulfide stabilization, on chimeric backbone |
| 2139 | H493 | *CNE58.SOSIP.R6.V1V2.A244 | CNE58/BG505 chimera | V1V2SOSIP; 664; R6; 201C, 433C | V1V2 Swap A244 | SOSIP, V1V2 swap, 201-422 disulfide stabilization, on chimeric backbone |

-continued

| SEQ ID NO | Code | Name | Native Background | Mutations Compared to Native Background | Additional mutations | Comment |
|---|---|---|---|---|---|---|
| 2140 | H494 | *CNE58.SOSIP.R6.V1V2.WITO | CNE58/BG505 chimera | V1V2SOSIP; 664; R6; 201C, 433C | V1V2 Swap WITO | SOSIP, V1V2 swap, 201-422 disulfide stabilization, on chimeric backbone |
| | | MDAMKRGLCCVLLLCGAVFVSPSASVGNLWVTVYYGVPVWKEAKTLFCASDAKAYEKEVHNVWATHACVPTDPNPQEVVLENVTENFNMKNDMVDQMQEDVISIWDQSLKPCVKLTPLCVTLNCTNVN VTSNSTNVNSSSTDNTTLGEIKNCSFDITTEIRDKTRKEYALFYRLDIVPLDNSSNPNSSNTYRLLINCNTSLTQACPKVTFDPIPIHYCAPAGYAILKCNNKTFNGKGPCNNVSTVQCTHGIKPVVSTQ LLLNGSLAEEEIVIRSKNLSDNAKIIIVQLNKSVEIVCTRPNNNTRRSIRIGPGQTFYATDIIGDIRQAYCNISGRNWSELYKYKVKVIEPLGVAPTDAKSSVVESNKSAVGIGAVFLGFLGAAGSTMGAASI NDTISNATIMLPCRIKQIINMWQEVGKAIYAPPIKGNITCKSDITGLLLLTRDGGNTTNNTEIFRPGGGDMRDNWRSELYKYKVKPLGVAPTDAKSSVVESNKSAVGIGAVFLGFLGAAGSTMGAASI TLTVQARQLLSGIVQQQSNLLRAIEAQQHMLQLTVWGIKQLQTRVLAIERYLKDQQLLGLWGCSGKLICTTAVPWNISWSNKSKEEIWENMTWMQQWDREINNYTNTIYRLLEESQNQQENNEKDLLALDS WNNLWNWFNITNWLWYIK | | | | | |
| 2141 | H495 | *CNE58.SOSIP.R6.V1V2.T250.4 | CNE58/BG505 chimera | V1V2SOSIP; 664; R6; 201C, 433C | V1V2 Swap T250.4 | SOSIP, V1V2 swap, 201-422 disulfide stabilization, on chimeric backbone |
| | | MDAMKRGLCCVLLLCGAVFVSPSASVGNLWVTVYYGVPVWKEAKTLFCASDAKAYEKEVHNVWATHACVPTDPNPQEVVLENVTENFNMKNDMVDQMQEDVISIWDQSLKPCVKLTPLCVTLNCTNVN VTSNSTNVNSSSTDNTTLGEIKNCSFDITTEIRDKTRKEYALFYRLDIVPLDNSSNPNSSNTYRLLINCNTSLTQACPKVTFDPIPIHYCAPAGYAILKCNNKTFNGKGPCNNVSTVQCTHGIKPVVSTQ LLLNGSLAEEEIVIRSKNLSDNAKIIIVQLNKSVEIVCTRPNNNTRRSIRIGPGQTFYATDIIGDIRQAYCNISGRNWSELYKYKVKVIEPLGVAPTDAKSSVVESNKSAVGIGAVFLGFLGAAGSTMGAASI NDTISNATIMLPCRIKQIINMWQEVGKAIYAPPIKGNITCKSDITGLLLLRDGDTTDNTEIFRPGGGDMRDNWRSELYKYKVKPLGVAPTDAISSVVESNKSAVGIGAVFLGFLGAAGSTMGAASI TLTVQARQLLSGIVQQQSNLLRAIEAQQHMLQLTVWGIKQLQTRVLAIERYLKDQQLLGLWGCSGKLICTTAVPWNISWSNKSKEEIWENMTWMQQWDREINNYTNTIYRLLEESQNQQENNEKDLLALDS WNNLWNWFNITNWLWYIK | | | | | |
| 2142 | 0 | 426c | | | | GenBank: KC769518.1, incorporated by reference herein as present in GenBank on September 3, 2015 |
| 2143 | 0 | 426c DNA | | | | |
| 2144 | 0 | 426c.N276D.N460D.N463D | | | | GenBank: KC769519.1, incorporated by reference herein as present in GenBank on September 3, 2015 |
| | | MDAMKRGLCCVLLLCGAVFVSPSASVGNLWVTVYYGVPVWKEAKTLFCASDAKAYETEVHNVWATHACVPTDPNPQEVLENVTENFNMWKNNMVEQMHEDIISLWDQSLKPCVKLTPLCVTLNC TDYLGNATNTTSSSGGAMEGGEIKNCSFNITTSMRDKMQKEYALFYKLDVVSIDNDNASTNYRLISCNTSVITQACPKISFEPIPIHYCAPAGFAILKCNDKKFNGTGPCTNVSTVQCTHGIRPVVSTQL LLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLF NSTWTWNDTEVVNNTEKNINITLPCRIKQIINMWQEVGKAMYAPPIKGQIRCSSNITGLLLTRDGGSSTNGTTETFRPGGGDMRDNWRSELYKYKVKIEPLGLAPTRAKRRVVQREKRAVGIGAVFLGF LGAAGSTMGAASMTLTVQARLLSGIVQQQNNLLRAIEAQQHLLQLTVWGIKQLQARVLAVERYLKDQQLLGIWGCSGKLICTTAVPWNASWSNKSLDKIWNNMTWMEWEREINNYTGLIYNLIEESQNQ QEKNEQELLELDKWASLWNWFDITKNWLWYIKIFIMIVGGLVGLRIIFTVLSIVNRVRQGYSPLSFQTHLPAPRGPDRPEGIGEEGEGQDRDRSDRIVTGFLAIFWDLRSLCLFSYHRLRDLLLIVTRIV ELLGRRGWEILKYWWNLLQYWNQELKNSAVSLLNATAIVVAEGTDRVIEVLQRAFRAVLNIPTRIRQGLERALL | | | | | |
| 2145 | 0 | 45_01dG5 | | | | |
| | | MRVMGIRKNCQRLWRGGTLFLGLMLFSAAENLWVTVYYGVPVWKEATATLFCASDAKAYETEVHNVWATHACVPTDPNPQEVLENVTENFNMWKNNMVEQMHEDIISLWDQSLKPCVKLTPLCVTLNC | | | | | |
| 2146 | H496 | *426c-v1v2-WITO-degly4-DS-gly504-gly661 | | | | BG505 platform; heterologous v1v2; remainder 426c with N276, N460 and N463 glycan mutations; 201C/433C; add 504/661 sequons for glycosylation of membrane proximal region |
| | | AENLWVTVYYGVPVWKEAKTLFCASDAKAYEKEVHNVWATHACVPTDPNPQEVVLENVTENFNMKNDMVDQMQEDVISIWDQSLKPCVKLTPLCVTLHCTNVTISSTNGSTANVTMREEMKNCSFNTT TVIRDKIQKEYALFYKLDIVPIEGKNTNTGYRLLINCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNK SVEIVCTRPNNNTRRSIRIGPGQTFYATDIIGDIRQAYCNISGRNWSELYKYKVKVIEPLGVAPTRCKRnvtGRRRRRRAVGIGAVFLGFLGAAGSTMGAASMTLTVQARNLLSGIVQQQSNLLRAPEAQQH PIKGNITCKSDITGLLLLRDGQLQARVLAVERYLKDQQLLGIWGCSGKLICCTTNVPWNSSWSNRNLSEIWDNMTWLQMDKEISNYTQIYGLLEESQNQQEKNEQDLnAtD LLKLITVWGIKQLQARVLAVERYLKDQQLLGIWGCSGKLICCTTNVPWNSSWSNRNLSEIWDNMTWLQMDKEISNYTQIYGLLEESQNQQEKNEQDLnAtD | | | | | |

| 1 SEQ ID NO | 2 Code | 3 Name | 4 Native Background | 5 Mutations Compared to Native Background | 6 Additional mutations | 7 Comment |
|---|---|---|---|---|---|---|
| 2147 | H497 | *426c-v1v2-WITO-degly3-DS-gly504-gly661 | AENLMWTVYYGVPVWKEAKTTLFCASDAKAYEKEVHNVWATHACVPTDPNPQEVVLENVTENFNMWKNDMDQMQEDVISIWDQSLKPCVKLTPLCVTLHCTNVISSTNGSTANVTMREEMKNCSFNTT TVIRDKIQKEYALFYKLDIVPIEGKNTNTGYRLINCNTsTCTQACPKVTFDPIPIHYCAPAGYAILKCNNKTFNGKGPCNNVSTVQCTHGIKPVVSTQLLNGSLAEEEIVIRSKNLADNAKIIIVQLNK SVEIVCTRPNNNTRRSIRIGPGQTFYATDIIGDIRQAYNISGRNWSEAVNQVKKKLKEHPHKNISFQSSSGGDLEITTHSFNCGGEFFYCNTSGLFNDTISNATIMLPCRIKQIINMWQEVGKCIYAPP IKGNITCKSDITGLLLLRDGGNTANNAEIFRPGGGDMRDNWRSELYKYKVVKIEPLGVAPTRCKRnvtGRRRRRRAVGIGAVFLGFLGAAGSTMGAASMTLTVQARNLLSGIVQQQSNLLRAPEAQQHLL KLTVWGIKQLQARVLAVERYLRDQQLLGIWGCSGKLICC -continued

| 1 SEQ ID NO | 2 Code | 3 Name | 4 Native Background | 5 Mutations Compared to Native Background | 6 Additional mutations | 7 Comment |
|---|---|---|---|---|---|---|
| 2151 | H501 | *d45-v1v2-WITO-01dG5chim-degly3-DS-gly504-gly661 | AENLWVTVYYGVPVWKEATATLFCASDAKAYETEVHNVWATHACVPTDPNPQEVVLENVTENFNMWKNNMVEQMHEDIISLWDQSLKPCVKLTPLCVTLHCTNVTISSTANVTMREEMKNCSFNTTTVIRDKIQKEYALFYKLDIVPIEGKNTNTGYRLINCNTsVCTQACPKISFEPIPIHYCAPAGFAILKCNDKKFNGTGPCTNVSTVQCTHGIRPVVSTQLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQaSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSTNGTTETFRPGGGDMRDNWRSELYKYKVVKIEPLGVAPTRCKRnVtGRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLnAtD | | | BG505 platform; heterologous V1V2; remainder 45_01dG5, 201C/433C; add 504/661 sequons for glycosylation of membrane proximal region |
| 2152 | H502 | *d45-v1v2-WITO-01dG5chim-degly4-DS-gly504-gly661 | AENLWVTVYYGVPVWKEATATLFCASDAKAYETEVHNVWATHACVPTDPNPQEVVLENVTENFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTaVCTQACPKISFEPIPIHYCAPAGFAILKCNDKKFNGTGPCTNVSTVQCTHGIRPVVSTQLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQaSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSTNGTTETFRPGGGDMRDNWRSELYKYKVVKIEPLGVAPTRCKRnVtGRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLnAtD | | | BG505 platform; heterologous V1V2; remainder 45_01dG5, 201C/433C; add 504/661 sequons for glycosylation of membrane proximal region |
| 2153 | H503 | *d45-v1v2-ZM233-01dG5chim-DS-gly504-gly661 | AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTsVCTQACPKISFEPIPIHYCAPAGFAILKCNDKKFNGTGPCTNVSTVQCTHGIRPVVSTQLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQsSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSTNGTTETFRPGGGDMRDNWRSELYKYKVVKIEPLGVAPTRCKRnVtGRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLnAtD | | | BG505 platform; heterologous V1V2; remainder 45_01dG5, 201C/433C; add 504/661 sequons for glycosylation of membrane proximal region |

| 1 SEQ ID NO | 2 Code | 3 Name | 4 Native Background | 5 Mutations Compared to Native Background | 6 Additional mutations | 7 Comment |
|---|---|---|---|---|---|---|
| 2154 | H504 | *d45-v1v2-ZM233-01dG5chim-degly3-DS-gly504-gly661 | AENLWVTVYYGVPVWKEATATLFCASDAKAYETEVHNVWATHACVPTDPNPQEVVLENVTENFNMWKNDMVEQMHEDIISLWDQSLKPCVKLTPLCVTLDCSTYNNTHNISKEMKICSFNMTTELRDKKR KVNVLFYKLDLVPLTNSSNTTNYRLISCNTsVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTR PNNNTRKSIPIGPGRAFYTTGAIIGDIRQAHCNISKAKWENTLKQIARKLREHFKNETIAFNQaSGGDPEIVMHSFNCGGEFFYCNSTQLFNSTWTWNDTEVVNNTEKNINITLPCRIKQIINMWQEVGK CMYAPPIKGQIRCSSNITGLLLTRDGGSSTNGTTETFRPGGGDMRDNWRSELYKYKVKIEPLGVAPTRCKRnVtGRRRRRRAVGIGAVFLGFLGAAGSTMGAASMTLTVQARNLLSGIVQQQSNLLRAP EAQQHLLKLITVWGIKQLQARVLAVERYLRDQQLLGIWGCSGKLICCTNVPWNSSWSNRNLSEIWDNMTWLQWDKEISNYTQIIYGLLEESQNQQEKNEQDLnAtD | | | BG505 platform; heterologous V1V2; remainder 45_01dG5, 201C/433C; add 504/661 sequons for glycosylation of membrane proximal region |
| 2155 | H505 | *d45-v1v2-ZM233-01dG5chim-degly4-DS-gly504-gly661 | AENLWVTVYYGVPVWKEATATLFCASDAKAYETEVHNVWATHACVPTDPNPQEVVLENVTENFNMWKNDMVEQMHEDIISLWDQSLKPCVKLTPLCVTLDCSTYNNTHNISKEMKICSFNMTTELRDKKR KVNVLFYKLDLVPLTNSSNTTNYRLISCNTaVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTR PNNNTRKSIPIGPGRAFYTTGAIIGDIRQAHCNISKAKWENTLKQIARKLREHFKNETIAFNQaSGGDPEIVMHSFNCGGEFFYCNSTQLFNSTWTWNDTEVVNNTEKNINITLPCRIKQIINMWQEVGK CMYAPPIKGQIRCSSNITGLLLTRDGGSSTNGTTETFRPGGGDMRDNWRSELYKYKVKIEPLGVAPTRCKRnVtGRRRRRRAVGIGAVFLGFLGAAGSTMGAASMTLTVQARNLLSGIVQQQSNLLRAP EAQQHLLKLITVWGIKQLQARVLAVERYLRDQQLLGIWGCSGKLICCTNVPWNSSWSNRNLSEIWDNMTWLQWDKEISNYTQIIYGLLEESQNQQEKNEQDLnAtD | | | BG505 platform; heterologous V1V2; remainder 45_01dG5, 201C/433C; add 504/661 sequons for glycosylation of membrane proximal region |
| 2156 | H506 | *Sc15ln 426c-v1v2-WITO-degly4-DS-gly504-gly661 | AENLWVTVYYGVPVWKEAKTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTT TVIRDKIQKEYALFYKLDIVPIEGKNTNTGYRLINCNTATCTQACPKVTFDDPIPIHYCAPAGYAILKCNNKTFNGKGPCNNVSTVQCTHGIKPVVSTQLLLNGSLAEEEIVIRSKNLADNAKIIIVQLNK SVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAP PIKGNITCKSDITGLLLLRDGGNTANNAEIFRPGGGDMRDNWRSELYKYKVKIEPLGVAPTRCKRnVtGGGGSGGGGSGGGGSGKLICCTNVPWNSSWSNRNLSEIWDNMTWLQWDKEISNYTQIIYGLLEESQNQQEKNEQDLnAtD RAPEAQQHLLKLITVWGIKQLQARVLAVERYLRDQQLLGIWGCSGKLICCTNVPWNSSWSNRNLSEIWDNMTWLQWDKEISNYTQIIYGLLEESQNQQEKNEQDLnAtD | | | BG505 platform; heterologous V1V2; remainder 426c with N276, N460 and N463 glycan mutations; 201C/433C; single chain format with 15 AA linker; add 504/661 sequons for glycosylation of membrane proximal region |

-continued

| SEQ ID NO | Code | Name | Native Background | Mutations Compared to Native Background | Additional mutations | Comment |
|---|---|---|---|---|---|---|
| 2157 | H507 | *Sc10ln 426c-v1v2-WITO-degly4-DS-gly504-gly661 | AENLWVTVYYGVPVWKEAKTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTT TVIRDKIQKEYALFYKLDIVPIEGKNTNTGVRLINCNTATCTQACPKVTFDPIPIHYCAPAGYAILKCNNKTFNGKGPCNNVSTVQCTHGIKPVSTQLLLNGSLAEEEIVIRSKNLADNAKIIVQLNK SVEIVCTRPNNNTRR It will be apparent that the precise details of the methods or compositions described may be varied or modified without departing from the spirit of the described embodiments. We claim all such modifications and variations that fall within the scope and spirit of the claims below. Unless indicated otherwise, HIV-1 Env amino acid positions listed in the following claims correspond to the HXB2 numbering system using the HXB2 reference sequence set forth as SEQ ID NO: 1

SEQUENCE LISTING (2159 sequences)

SEQ ID NO: 1 - protein, 856 aa, Human immunodeficiency virus
MRVKEKYQHLWRWGWRWGTMLLGMLMICSATEKLWVTVYYGVPVWKEATTTLFCASDAKAYDTEVHNVWATHACVPTDPNPQEVVLVNVTENFNMWKNDMVEQMHEDIISLWDQSLKPCVKLTPLCVSLKCTDLKNDTNTNSSSGRMIMEKGEIKNCSFNISTSIRGKVQKEYAFFYKLDIIPIDNDTTSYKLTSCNTSVITQACPKVSFEPIPIHYCAPAGFAILKCNNKTFNGTGPCTNVSTVQCTHGIRPVVSTQLLLNGSLAEEEVVIRSVNFTDNAKTIIVQLNTSVEINCTRPNNNTRKRIRIQRGPGRAFVTIGKIGNMRQAHCNISRAKWNNTLKQIASKLREQFGNNKTIIFKQSSGGDPEIVTHSFNCGGEFFYCNSTQLFNSTWFNSTWSTEGSNNTEGSDTITLPCRIKQIINMWQKVGKAMYAPPISGQIRCSSNITGLLLTRDGGNSNNESEIFRPGGGDMRDNWRSELYKYKVVKIEPLGVAPTKAKRRVVQREKRAVGIGALFLGFLGAAGSTMGAASMTLTVQARQLLSGIVQQQNNLLRAIEAQQHLLQLTVWGIKQLQARILAVERYLKDQQLLGIWGCSGKLICTTAVPWNASWSNKSLEQIWNHTTWMEWDREINNYTSLIHSLIEESQNQQEKNEQELLELDKWASLWNWFNITNWLWYIKLFIMIVGGLVGLRIVFAVLSIVNRVRQGYSPLSFQTHLPTPRGPDRPEGIEEEGGERDRDRSIRLVNGSLALIWDDLRSLCLFSYHRLRDLLLIVTRIVELLGRRGWEALKYWWNLLQYWSQELKNSAVSLLNATAIAVAEGTDRVIEVVQGACRAIRHIPRRIRQGLERILL

SEQ ID NO: 2 - protein, 860 aa, Human immunodeficiency virus
MRVMGIQRNCQHLFRWGTMILGMIIICSAAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGREKRAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKISAINLFDTIAIAVAEWTDRVIEIGQRLCRAFLHIPRRIRQGLERALL

SEQ ID NO: 3 - protein, 633 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGREKRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 4 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEFRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 5 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEWRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 6 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 7 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGPAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 8 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYCLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYCTGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 9 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLCYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYACGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 10 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCACAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQCRVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 11 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPCGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLCVERYLRDQQLLGIWGCSGKLICCTNVPWNSSWSNRNLSEIWDNMTWLQWDKEISNYTQIIYGLLEESQNQQEKNEQDLLALD

SEQ ID NO: 12 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGCGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 13 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVACTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPCNSSWSNRNLSEIWDNMTWLQWDKEISNYTQIIYGLLEESQNQQEKNEQDLLALD

SEQ ID NO: 14 - protein, 634 aa, Artificial Sequence
  Recombinant HIV protein
AENLWVTVYYCVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAAGSTMGAASMTLTVCARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 15 - protein, 634 aa, Artificial Sequence
  Recombinant HIV protein
AENLWVTVYYGVCVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGACGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 16 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPCGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLCVERYLRDQQLLGIWGCSGKLICTTNVPWNSSWSNRNLSEIWDNMTWLQWDKEISNYTQIIYGLLEESQNQQEKNEQDLLALD

SEQ ID NO: 17 - protein, 634 aa, Artificial Sequence
  Recombinant HIV protein
AENLWVTVYYGVPVWKDAETTLFCASDAKAYETEKHNVWATHACVPTDPNPQEIHLECVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAACSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 18 - protein, 634 aa, Artificial Sequence
  Recombinant HIV protein
AENLWVTVYYGVCVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVCARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 19 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTCLRDKKQKVYSLFYRLDVVQINENQGNRSNNSNKEYRLINCCTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 20 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTCLCVTLQCTNVTNNITDDMRGELKNCSFNMTTELCDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 21 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLCVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQCINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 22 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLICCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQCINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 23 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLICCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 24 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTCAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 25 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTCAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRICQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 26 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 27 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYACGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPCIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 28 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLCVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRICQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 29 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTWGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 30 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSYNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 31 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGWAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 32 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGWAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNYLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 33 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFFGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 34 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGYLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 35 - protein, 634 aa, Artificial Sequence
  Recombinant HIV protein
AENLQVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 36 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPCGFAILKCKDKKFNGTGPCPSVSTVQCTHGIKPVVSTQLLLNGSLAEEEVMIRSENITNNAKNILVQFNTPVQINCTRPNNNTRKSIRIGCGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLCVERYLRDQQLLGIWGCSGKLICTTNVPWNSSWSNRNLSEIWDNMTWLQWDKEISNYTQIIYGLLEESQNQQEKNEQDLLALD

SEQ ID NO: 37 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGEAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 38 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGDAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 39 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAPYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 40 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMPAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 41 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYPPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 42 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAAPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 43 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPAIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 44 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAAAIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 45 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNIWDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDRRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 46 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRWDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 47 - protein, 634 aa, Artificial Sequence
  Recombinant HIV protein
AENLWVTVFYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAAVMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 48 - protein, 634 aa, Artificial Sequence
  Recombinant HIV protein
AENLWVTVWYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGATMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 49 - protein, 634 aa, Artificial Sequence
  Recombinant HIV protein
AENLWVVVFYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPVRCKRRVVGRRRRRRAVGIGAVFLGFLGAAGSTMGAAVMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 50 - protein, 634 aa, Artificial Sequence
  Recombinant HIV protein
AENLWVVVFFGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPVRCKRRVVGRRRRRRAVGIGAVFLGFLGAAGSTMGAAVMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 51 - protein, 852 aa, Human immunodeficiency virus
MTVTGTWRNYQQWWIWGILGFWMLMICNGLWVTVYYGVPVWREAKTTLFCASDAKSYEKEVHNVWATHACVPTDPNPQELVLKNVTENFNMWKNDMVDQMHEDIISLWDQSLKPCVKLTPLCVTLNCSDAKVNINATYNGTREEIKNCSFNATTELRDKKKKEYALFYRLDIVPLNKEGNNNSEYRLINCNTSVITQACPKVTFDPIPIHYCAPAGYAILKCNNKTFNGTGPCNNVSTVQCTHGIKPVVSTQLLLNGSLAEEEIIIRSENLTDNVKTIIVHLNESVEINCTRPNNNTRKSIRIGPGQTFYATGDIIGDIRQAHCNISEIKWEKTLQRVSEKLREHFNKTIIFNQSSGGDLEITTHSFNCGGEFFYCNTSDLFFNKTFDETYSTGSNSTNSTITLPCRIKQIINMWQEVGRAMYASPIAGEITCKSNITGLLLTRDGGGNNSTEETFRPGGGNMRDNWRSELYKYKVVEVKPLGIAPTEARRRVVQKEKRAVVGLGAVFLGFLGTAGSTMGAASITLTVQARQLLSGIVQQQSNLLRAIEAQQHMLQLTVWGIKQLQARVLAIERYLKDQQLLGMWGCSGKLICTTNVYWNSSWSNKTYNEIWDNMTWMQWDREIDNYTDTIYKLLEVSQKQQESNEKDLLALDSWNNLWNWFDISKWLWYIKIFIMIVGGLIGLRIIFAVLSLVNRVRQGYSPLSFQTLTPNPRELDRLGGIEEEGGEQDRDRSIRLVSGFFSLAWNDLRSLCLFCYHRLRDFILIAGRAVELLGRSSLQGLQRGWEILKYLGSLVQYWGLELKKSAINLFDTIAIAVAEGTDRIIEFLQRIVRAILHIPRRIRQGFEAALQ

SEQ ID NO: 52 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIICMWQRCGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 53 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFCATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYACPIQGVIRCVSNITGLILTRDGGSTNSTTETFRPGGADMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 54 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINWWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 55 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYCLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYCTGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGADMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 56 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSCFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYACGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGADMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 57 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLCYRLCVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 58 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQCCPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYCPPIQGVIRCVSNITGLILTRDGGSTNSTTETFRPGGADMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 59 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQCCPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQACYAPPIQGVIRCVSNITGLILTRDGGSTNSTTETFRPGGADMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 60 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFECIPIHYCAPAGFAILKCKDKKFNGTGPCPSVSTVQCTHGICPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 61 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCACAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 62 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPCQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 63 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQCCPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQACYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 64 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKCTPCCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 65 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGADMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 66 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGSDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 67 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGYDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 68 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIPQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 69 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIICMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 70 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCCKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGCAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 71 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTCLCVTLQCTNVTNNITDDMRGELKNCSFNMCTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 72 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVCLQCTNVTNNITDDMRGELKNCSFNMTTELRCKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGADMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 73 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGECFYCNTSGLFNSTWISNTSVQGSNSTGSNDSITLPCRIKQICNMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 74 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTCPNNNTRKSIRIGPGQAFYATGDIIGDIRQCHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 75 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINPWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 76 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEWRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGADMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 77 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKCTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 78 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINAWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 79 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEWRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 80 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANCSGGDLEVCTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 81 - protein, 855 aa, Human immunodeficiency virus
MRVMGIQRNCQHLLTWGIMILGTIIFCSAVENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNISEGKEEIKNCSFNITTELRDKRKKVYSLFYRLDVVQIDEGDKNSTQYRLINCNTSAITQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGNIRQAHCNVSRSEWNKTLQQVAKQLGKYFGNKKVIFNSSSGGDLEITTHSFNCGGEFFYCNTSGLFNSTWTWDNSTWNQVNSTESNDTIILQCRIKQIINMWQRTGQAIYAPPIQGEIRCVSNITGLLLTRDGGNNNGTSETFRPEGGNMRDNWRSELYKYKVVEIEPLGVAPTRAKRRVVEREKRAVGIGAVFLGFLGAAGSTMGATSITLTVQARQLLSGIVQQQNNLLRAIEAQQHLLKLTVWGIKQLQARVLAVERYLRDQQLLGIWGCSGKLICTTNVPWNSSWSNKSLDEIWNNMTWLQWDKEINNYTQLIYRLIEESQNQQEKNEKELLELDKWANLWSWFDISNWLWYIKIFIIIVGGLIGLRIVFAVLSVINRVRQGYSPLSFQTHTPNPRGLDRPERIEEEDGEQGRGRSIRLVSGFLALAWDDLRSLCLFSYHRLRDFILIAARTVELLGHSSLKGLRLGWEGIKYLWNLLSYWGRELKISAINLVDTIAIAVAGWTDRVIEIAQRIGRAILHIPVRIRQGLERALL

SEQ ID NO: 82 - protein, 634 aa, Artificial Sequence
  Recombinant HIV protein
AENLWCTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNCPWNSSWSNRNLSEIWDNMTWLQWDKEISNYTQIIYGLLEESQNQQEKNEQDLLALD

SEQ ID NO: 83 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINFWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 84 - protein, 634 aa, Artificial Sequence
  Recombinant HIV protein
AENLWVTVYYGVPVWKDAETTLFCASDAKAYETEKHNVPATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 85 - protein, 634 aa, Artificial Sequence
  Recombinant HIV protein
AENLWVTVYYGVPVWKDAETTLFCASDAKAYETEKHNPWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 86 - protein, 634 aa, Artificial Sequence
  Recombinant HIV protein
AENLWVTVYYGVPVWKDAETTLFCASDAKAYETEKHNVWAPHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 87 - protein, 634 aa, Artificial Sequence
  Recombinant HIV protein
AENLWVTVYYGVPVWKDAETTLFCASDAKAYETEKCNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPCVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 88 - protein, 634 aa, Artificial Sequence
  Recombinant HIV protein
AENLWVTVYYGVPVWKDAETTLFCASDAKAYETEKHNVWATHCCVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWCIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 89 - protein, 634 aa, Artificial Sequence
  Recombinant HIV protein
AENLWVTVYYGVPVWKDAETTLCCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKCLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 90 - protein, 634 aa, Artificial Sequence
  Recombinant HIV protein
AENLWVTVYYGVPVWKDAETTLFCASDAKAYETEKHNVWATHACWPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 91 - protein, 634 aa, Artificial Sequence
  Recombinant HIV protein
AENLWVTVYYGVPVWKDAETTLFCASDAKAYETEKHNVWATHACFPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 92 - protein, 634 aa, Artificial Sequence
  Recombinant HIV protein
AENLWVTVYYGVPVWKDAETTLFCASDAKAYETEKHNVWATHACMPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 93 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKWSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 94 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKYSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 95 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKFSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 96 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKMSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 97 - protein, 634 aa, Artificial Sequence
  Recombinant HIV protein
AENLWVTVYYGVPVWKDAETTLFCASDCKAYETEKHNVWATHACVPCDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 98 - protein, 634 aa, Artificial Sequence
  Recombinant HIV protein
AENLWVTVYYGVPVWKDAETTLFCASCAKAYETEKHNVWATHACVPCDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 99 - protein, 634 aa, Artificial Sequence
  Recombinant HIV protein
AENLWVTVYYGVPVWKDAETTLFCASDAKAYETEKHNCWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVCFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 100 - protein, 634 aa, Artificial Sequence
  Recombinant HIV protein
AENLWVTVYYGVPVWKDAETTLFCASDAKAYETEKHNCWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKCSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 101 - protein, 634 aa, Artificial Sequence
  Recombinant HIV protein
AENLWVTVYYGVPVWKDAETTLFCASDAKAYETEKCNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVCFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 102 - protein, 634 aa, Artificial Sequence
  Recombinant HIV protein
AENLWVTVYYGVPVWKDAETTLFCASDAKAYETEKHPVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 103 - protein, 634 aa, Artificial Sequence
  Recombinant HIV protein
AENLWVTVYYGVPVWKDAETTLFCASDAKAYETEKPNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 104 - protein, 634 aa, Artificial Sequence
  Recombinant HIV protein
AENLWVTVYYGVPVWKDAETTLFCASDAKAYETEKPPVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 105 - protein, 634 aa, Artificial Sequence
  Recombinant HIV protein
AENLWVTVYYGVPVWKDAETTLFCASDCKAYETEKPPVWATHACVPCDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 106 - protein, 634 aa, Artificial Sequence
  Recombinant HIV protein
AENLWVTVYYGVPVWKDAETTLFCASCAKAYETEKPPVWATHACVPCDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 107 - protein, 857 aa, Human immunodeficiency virus
MRVMGIQRNCQHLLRRGTMILGMIIICGTAEDLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQAMYAPPIQGVIRCQSNITGILLTRDGGNTGNNSRTNETFRPGGGDMRDNWRSELYKYKVVKIEPLGVAPTKAKRRVVEREKRAVGLGAVFIGFLGAAGSTMGAASITLTVQARQLLSGIVQQQSNLLRAIEAQQHLLKLTVWGIKQLQARVLAVERYLKDQQLLGIWGCSGKLICTTNVPWNSSWSNKSYNEIWENMTWLQWDKEINNYTELIYSLIEESQNQQEKNEQDLLALDKWASLWNWFDISNWLWYIKIFIMIVGGLIGLRIVVAVLSVINRVRQGYSPLSFQTHTPNPRGLDRPERIEEEGGEQDRTRSTRLVSGFLALAWDDLRSLSLFLYHRLRDFILIAARTVELLGHSSLKGLRLGWEGLKYLWNLLLYWGRELKLSAINLLNTIAIAVAGWTDRVIEIGQGIGRAILHIPRRIRQGFERALL

SEQ ID NO: 108 - protein, 634 aa, Artificial Sequence
  Recombinant HIV protein
AENLWVTVYYGVPVWKDAETTLFCASDAKAYETEKPPCWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKCSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 109 - protein, 634 aa, Artificial Sequence
  Recombinant HIV protein
AENLWVTVYYGVPVWKDAETTLFCASDAKAYETEKPPCWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVCFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 110 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGAMADNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 111 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLIDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 112 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLMDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 113 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMIQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 114 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMMQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 115 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQNIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 116 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQLIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 117 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMMQLIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 118 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGAMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 119 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMADNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 120 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSYNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDG

SEQ ID NO: 121 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCCTLQCTNVTNNITDDMRGELKNCSFNMTTELCGDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 122 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCCTLQCTNVTNNITDDMRGELKNCSFNMTTELCGDKKQKVYSLFYRLDVVQINENQGNRSNNSNKEYRLINCNTCAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRICPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 123 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLLVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIWQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 124 - protein, 636 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTCAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGGCQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 125 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCGCTLQCTNVTNNITDDMRGELKNCSFNMTTELCDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 126 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTCAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRICPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 127 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTCAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPCGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 128 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCWKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 129 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCWKLTPLCVTLQCTNVTNNITDDMRGELKNCSFNMTTELRDKKQKVYSLFYRLDVVQINENQGNRSNNSNKEYRLINCNTSAITVACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 130 - protein, 633 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 131 - protein, 633 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTWCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 132 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMEGWLKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRWAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 133 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSWNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 134 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAWYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 135 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNWTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 136 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRWGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 137 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPRCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQADYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 138 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPECVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQARYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 139 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQWLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 140 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKWCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 141 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACAKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 142 - protein, 633 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 143 - protein, 634 aa, Artificial Sequence
  Recombinant HIV protein
AENLWVTVYYGVPVWKDAETTLFCASDAKAYETEKHNVWYTHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 144 - protein, 634 aa, Artificial Sequence
  Recombinant HIV protein
AENLWVTVYYGVPVWKDAETTLFCASDAKAYETEKHNVWFTHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 145 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISYWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 146 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISFWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 147 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAIPQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 148 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCPKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 149 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCTKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 150 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKKTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 151 - protein, 634 aa, Artificial Sequence
  Recombinant HIV protein
AENLWVTVYYGVPVWKDAETCLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGCGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGICQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 152 - protein, 634 aa, Artificial Sequence
  Recombinant HIV protein
AENLWVTVYYGVPVWKDAETTLCCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGCGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGICQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 153 - protein, 634 aa, Artificial Sequence
  Recombinant HIV protein
AENLWVTVYYGVPVWKDAETCLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGCGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQCRVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 154 - protein, 634 aa, Artificial Sequence
  Recombinant HIV protein
AENLWVTVYYGVPVWKDAETCLFCASDAKAYETEKHNVWATHACVPTDPNPQEIHLENVTEEFNMWKNNMVEQMHTDIISLWDQSLKPCVKLTPLCVCLQCTNVTNNITDDMRGELKNCSFNMTTECRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGCGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGICQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 155 - protein, 634 aa, Artificial Sequence
  Recombinant HIV protein
AENLWVTVYYGVPVWKDAETTLCCASDAKAYETEKHNVWATHACVPTDPNPQEIHLENVTEEFNMWKNNMVEQMHTDIISLWDQSLKPCVKLTPLCVCLQCTNVTNNITDDMRGELKNCSFNMTTECRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGCGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGICQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 156 - protein, 634 aa, Artificial Sequence
  Recombinant HIV protein
AENLWVTVYYGVPVWKDAETCLFCASDAKAYETEKHNVWATHACVPTDPNPQEIHLENVTEEFNMWKNNMVEQMHTDIISLWDQSLKPCVKLTPLCVCLQCTNVTNNITDDMRGELKNCSFNMTTECRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGCGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQCRVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 157 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGTKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 158 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 159 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGTKQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 160 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGTEQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 161 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGTTQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 162 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKCTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 163 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWCRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPCAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 164 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWCRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPECQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 165 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWCRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEACQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 166 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTCIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGICQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 167 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVCQQSNLLRAPEAQQHLLKLTVWGIKCLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 168 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQCQSNLLRAPEAQQHLLKLTVWGIKCLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 169 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVCQQSNLLRAPEAQQHLLKLTVWGIKQLQACVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 170 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLCVTTHSFNCGGEFFYCNTSGLFNSTWISNTSVQGSNSTGSNDSITLPCRIKQIINCWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQAQVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 171 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGCEFFYCNTSGLFNSTWISNTSVQGSNSTGSNDSITLPCRIKQIINCWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQAQVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 172 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLWPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 173 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAWTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQWINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 174 - protein, 873 aa, Human immunodeficiency virus
MRVTGIRKNCRRLWRWGIMLLGMLMICSALENLWVTVYYGVPVWKDATTTLFCASDAKGYETEVHNVWATHACVPTDPNPQELVLGNVTENFNMWKNDMVDQMHEDVISLWDQSLKPCVKLTPLCVTLKCKDVSINNGNVSSSNGSTSHNNSSIDNETLNEGMKEMKNCSFNATTVLRDKKQKVHALFYRLDIVPLNESNKNSRKYRLINCNTSAITQACPKVTFDPIPIHYCAPAGYAILKCNNKTFNGTGPCRNVSTVLCTHGIKPVVSTQLLLNGSLAEEDIIIRSENLTNNAKTIIVHLNESVEIVCTRPGNNTRKGIGIGPGQTFYATGEIIGDIRKAHCNISKDNWTETLYRVSRKLKHFWNKTIIFAPHSGGDLEITTHSFNCRGEFFYCNTSGLFNGTLNDTYMHNSTKSNETITIPCKIRQIVRMWQQVGQAMYAPPIEGNITCKSNITGLLLVRDGGNINRTNETFRPEGGDMRDNWRSELYKYKVVEIKPLGIAPTKAKRRVVEREKRAVGLGAVFLGFLGIAGSTMGAASITLTVQARQLLSGIVQQQNNLLKAIEAQQHLLQLTVWGIKQLQARVLAIERYLKDQQLLGIWGCSGKLICTTAVAWNSSWSNKSLGEIWDNMTWMQWDKEINNYTSIIYSLLEDSQIQQEKNEKDLLALDSWNNLWNWFDITSWLWYIRLFIMIVGGLIGLRIIFAVLSIVNRVRQGYSPLSFQTLTPNPIPGGPDRLGRIEEEGGEQDRDRSIRLVSGFLALAWDDLRNLCLFSYHRLRDFILVTARVVELLGRSSLRGLQRGWEALKYLGSLVQYWGQELKKSAISLIDTIAITVAEGTDRIIEAVQRLCRGIYNIPRRIRQGFEAALQ

SEQ ID NO: 175 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLWPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 176 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLEPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 177 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVELTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 178 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIIWLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 179 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDWSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 180 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAWAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 181 - protein, 634 aa, Artificial Sequence
  Recombinant HIV protein
AENLWVTVYYGVPVWKDAEWTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 182 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQWIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 183 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCWKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 184 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVWLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 185 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLWPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 186 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLWPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 187 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLEPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 188 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVELTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 189 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINWWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 190 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIIWLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 191 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDWSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 192 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAWAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 193 - protein, 634 aa, Artificial Sequence
  Recombinant HIV protein
AENLWVTVYYGVPVWKDAEWTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 194 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQWIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 195 - protein, 634 aa, Artificial Sequence
  Recombinant HIV protein
AENLWVTVYYGVPVWKDAETTLFCASDAKAWETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 196 - protein, 634 aa, Artificial Sequence
  Recombinant HIV protein
AENLWVTVYYGVPVWKDAETTLFCASDAKAYETEKHNLWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVRFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 197 - protein, 634 aa, Artificial Sequence
  Recombinant HIV protein
AENLWVTVYYGVPVWKDAETTLWCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVWCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 198 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFWRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDFIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 199 - protein, 633 aa, Artificial Sequence
  Recombinant HIV protein
ENLWVTVYYCVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQCRNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 200 - protein, 633 aa, Artificial Sequence
  Recombinant HIV protein
ENLWVTVYYCVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQCRNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 201 - protein, 633 aa, Artificial Sequence
  Recombinant HIV protein
ENLWVTVYYCVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAAGSTMGAASMTLTVQCRNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 202 - protein, 621 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGGGPGGPGGTVWGTKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 203 - protein, 621 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGGGGPGGPGTVWGIKQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 204 - protein, 620 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGGGGPGGGTVWGTKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 205 - protein, 623 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGGGPGGGGPGGTVWGTKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 206 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQPQSNLLRAPEAQQHLLKLTVWGTTQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 207 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLPRAPEAQQHLLKLTVWGTTQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 208 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQPLLKLTVWGTTQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 209 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKPTVWGTTQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 210 - protein, 638 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 211 - protein, 638 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 212 - protein, 639 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGSGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 213 - protein, 639 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGSGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 214 - protein, 640 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGSGGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 215 - protein, 640 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGSGGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 216 - protein, 641 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 217 - protein, 641 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 218 - protein, 642 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGSGGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 219 - protein, 642 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGSGGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 220 - protein, 643 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 221 - protein, 643 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 222 - protein, 629 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 223 - protein, 629 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 224 - protein, 648 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 225 - protein, 648 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 226 - protein, 630 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 227 - protein, 630 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 228 - protein, 631 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 229 - protein, 631 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 230 - protein, 632 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 231 - protein, 632 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 232 - protein, 633 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 233 - protein, 633 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 234 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 235 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 236 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 237 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 238 - protein, 636 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 239 - protein, 636 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGSGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 240 - protein, 637 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 241 - protein, 637 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 242 - protein, 638 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 243 - protein, 638 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQFQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 244 - protein, 639 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGSGGSGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 245 - protein, 640 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGSGGGSGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 246 - protein, 641 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGGSGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 247 - protein, 642 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGSGGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 248 - protein, 643 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 249 - protein, 629 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 250 - protein, 630 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 251 - protein, 631 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 252 - protein, 632 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 253 - protein, 633 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGSGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 254 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGSGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 255 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 256 - protein, 636 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGSGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 257 - protein, 637 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 258 - protein, 621 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVTTNVPWNSSWSNRNLSEIWDNMTWLQWDKEISNYTQIIYGLLEESQNQQEKNEQDLLALDGGGSGGGGSGGGSGGGSGGGSGGGSGGTVQARNLLSGIVQQQSNLLRAPEAQQHLLKLTVWGIKQLQARVLAVERYLRDQQLLGIWG

SEQ ID NO: 259 - protein, 594 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGGSGGGGSGGGSGGGSGGGSGGGSGGSMTLTVQARNLLSGIVQQQSNLLRAPEAQQHLLKLTVWGIKQLQARVLAVERYLRDQQLLGIWIEDKIEEILSKQYHIENEIARIKKLIGER

SEQ ID NO: 260 - protein, 623 aa, Artificial Sequence
  Recombinant HIV protein
AAVGIGAVFLGFLGAAGSTMGAASMTLTVQARNLLSGIVQQQSNLLRAPEAQQHLLKLTVWGIKQLQARVLAVERYLRDQQLLGIWGGGGSGGGENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAGTTNVPWNSSWSNRNLSEIWDNMTWLQWDKEISNYTQIIYGLLEESQNQQEKNEQDLLALD

SEQ ID NO: 261 - protein, 597 aa, Artificial Sequence
  Recombinant HIV protein
ATVQARNLLSGIVQQQSNLLRAPEAQQHLLKLTVWGIKQLQARVLAVERYLRDQQLLGIWCGGGSGGGENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTCAGTTNVPWNSSWSNRNLSEIWDNMTWLQWDKEISNYTQIIYGLLEESQNQQEKNEQDLLALD

SEQ ID NO: 262 - protein, 597 aa, Artificial Sequence
  Recombinant HIV protein
ATVQARNLLSGIVQQQSNLLRAPEAQQHLLKLTVWGIKQLQARVLAVERYLRDQQLLGIWGGGGSGGGENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAGTTNVPWNSSWSNRNLSEIWDNMTWLQWDKEISNYTQIIYGLLEESQNQQEKNEQDLLALD

SEQ ID NO: 263 - protein, 597 aa, Artificial Sequence
  Recombinant HIV protein
ATVQARNLLSGIVQQQSNLLRAPEAQQHLLKLTVWCCKQILARQLAIERYIRDIQLLGIWCGGGSGGGENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTCAGTTNVPWNSSWSNRNLSEIWDNMTWLQWDKEISNYTQIIYGLLEESQNQQEKNEQDLLALD

SEQ ID NO: 264 - protein, 594 aa, Artificial Sequence
  Recombinant HIV protein
ATVQARNLLSGIVQQQSNLLRAIEAQQHLLKLTVWGIKQILARQLAIERYIRDIQLLGIWGCSGGENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAGKLICTTNVPWNSSWSNRNLSEIWDNMTWLQWDKEISNYTQIIYGLLEESQNQQEKNEQDLLALD

SEQ ID NO: 265 - protein, 594 aa, Artificial Sequence
  Recombinant HIV protein
ATVQARNLLSGIVQQQSNLLRAIEAQQHLLKLTVWGIKQILARQLAIERYIRDIQLLGIWGCGENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAGSGKLICTTNVPWNSSWSNRNLSEIWDNMTWLQWDKEISNYTQIIYGLLEESQNQQEKNEQDLLALD

SEQ ID NO: 266 - protein, 594 aa, Artificial Sequence
  Recombinant HIV protein
ATVQARNLLSGIVQQQSNLLRAIEAQQHLLKLTVWGIKQILARQLAIERYIRDIQLLGIWGCSGKLIGENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAGCTTNVPWNSSWSNRNLSEIWDNMTWLQWDKEISNYTQIIYGLLEESQNQQEKNEQDLLALD

SEQ ID NO: 267 - protein, 592 aa, Artificial Sequence
  Recombinant HIV protein
ATVQARNLLSGIVQQQSNLLRAIEAQQHLLKLTVWGIKQLQARVLAVERYLRDQQLLGIWGCSGENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAKLICTTNVPWNSSWSNRNLSEIWDNMTWLQWDKEISNYTQIIYGLLEESQNQQEKNEQDLLALD

SEQ ID NO: 268 - protein, 592 aa, Artificial Sequence
  Recombinant HIV protein
ATVQARNLLSGIVQQQSNLLRAIEAQQHLLKLTVWGIKQLQARVLAVERYLRDQQLLGIWGCENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVASGKLICTTNVPWNSSWSNRNLSEIWDNMTWLQWDKEISNYTQIIYGLLEESQNQQEKNEQDLLALD

SEQ ID NO: 269 - protein, 597 aa, Artificial Sequence
  Recombinant HIV protein
ATVQARNLLSGIVQQQSNLLRAPEAQQHLLKLTVWGIKQLQARVLAVERYLRDQQLLGIWGGGGSGGGENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAGTTNVPWNSSWSNRNLSEIWDNMTWLQWDKEISNYTQIIYGLLEESQNQQEKNEQDLLALD

SEQ ID NO: 270 - protein, 618 aa, Artificial Sequence
  Recombinant HIV protein
AVGLGAMFLGFLGAAGSTMGAASITLTVQARQLLSGIVQQQNNLLRAIEAQQHMLQLTVWGIKQLQARVLAIERYLKDQQLLGLWGCSGKLVCTTAGGSGGGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGSGGVPWNSSWSNKSQEDIWNNTTWMQWDKEVSNYTKTIYKLLEKSQNQQEENEKDLLALD

SEQ ID NO: 271 - protein, 601 aa, Artificial Sequence
  Recombinant HIV protein
AVGLGAMFLGFLGAAGSTMGAASITLTVQARQLLSGIVQQQNNLLRAIEAQQHMLQLTVWGIKQLQARVLAIERYLKDQQLLGLWGCSGKLVCTTAGGSGGGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGSGGNKSQEDIWNNTTWMQWDKEVSNYTKTIYKLLEKSQNQQEENEKDLLALD

SEQ ID NO: 272 - protein, 618 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 273 - protein, 618 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGWGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 274 - protein, 618 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGWGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 275 - protein, 618 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 276 - protein, 585 aa, Artificial Sequence
  Recombinant HIV protein
STMGAASITLTVQARQLLSGIVQQQNNLLRAIEAQQHMLQLTVWGIKQLQARVLAIERYLKDQQLLGLWGCSGKLVCTTAGGSGGGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGSGGNKSQEDIWNNTTWMQWDKEVSNYTKTIYKLLEKSQNQQEENEKDLLALD

SEQ ID NO: 277 - protein, 602 aa, Artificial Sequence
  Recombinant HIV protein
STMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 278 - protein, 602 aa, Artificial Sequence
  Recombinant HIV protein
STMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGWGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 279 - protein, 602 aa, Artificial Sequence
  Recombinant HIV protein
STMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGWGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 280 - protein, 602 aa, Artificial Sequence
  Recombinant HIV protein
STMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 281 - protein, 578 aa, Artificial Sequence
  Recombinant HIV protein
ITLTVQARQLLSGIVQQQNNLLRAIEAQQHMLQLTVWGIKQLQARVLAIERYLKDQQLLGLWGCSGKLVCTTAGGSGGGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGSGGNKSQEDIWNNTTWMQWDKEVSNYTKTIYKLLEKSQNQQEENEKDLLALD

SEQ ID NO: 282 - protein, 594 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 283 - protein, 594 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGWGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 284 - protein, 594 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGWGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 285 - protein, 594 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 286 - protein, 643 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGGSGGSGGSGGSGGSGGSGGSGGSSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDG

SEQ ID NO: 287 - protein, 643 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGGSGGSGGSGGSGGSGGSGGSGGSGGSGGSSMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDG

SEQ ID NO: 288 - protein, 643 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGGSGGSGGSGGSGGSGGSGGSGGSGGSGGSGGTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDG

SEQ ID NO: 289 - protein, 647 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGSGGSGGSGGSGGSGVGIGGVFLGFLGGAGSTMGAGSMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDG

SEQ ID NO: 290 - protein, 637 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALD

SEQ ID NO: 291 - protein, 637 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALD

SEQ ID NO: 292 - protein, 621 aa, Artificial Sequence
  Recombinant HIV protein
STMGAASMTLTVQARNLLSGIVQQQSNLLRAPEAQQHLLKLTVWGIKQLQARVLAVERYLRDQQLLGIWGCSGKLICTTAGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALD

SEQ ID NO: 293 - protein, 613 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALD

SEQ ID NO: 294 - protein, 609 aa, Artificial Sequence
  Recombinant HIV protein
AVGLGAMFLGFLGAAGSTMGAASITLTVQARQLLSGIVQQQNNLLRAIEAQQHMLQLTVWGIKQLQARVLAIERYLKDQQLLGLWGCSGKLVCTTAGGSGGGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGSGGVPWNSSWSNKSQEDIWNNTTWMQWDKEVSNYTKTIYKLLEKSQNQQEENEKDLLALD

SEQ ID NO: 295 - protein, 626 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALD

SEQ ID NO: 296 - protein, 626 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALD

SEQ ID NO: 297 - protein, 610 aa, Artificial Sequence
  Recombinant HIV protein
STMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALD

SEQ ID NO: 298 - protein, 602 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALD

SEQ ID NO: 299 - protein, 629 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 300 - protein, 629 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELWDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 301 - protein, 613 aa, Artificial Sequence
  Recombinant HIV protein
STMGAASMTLTVQARNLLSGIVQQQSNLLRAPEAQQHLLKLTVWGIKQLQARVLAVERYLRDQQLLGIWGCSGKLICTTAGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 302 - protein, 605 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALD

SEQ ID NO: 303 - protein, 631 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVGGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRCKRRVGGSGGSGGWNSSWSNRNLSEIWDNMTWLQWDKEISNYTQIIYGLLEESQNQQEKNEQDLLALD

SEQ ID NO: 304 - protein, 629 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNGGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRCKRRVGGSGGVPWNSSWSNRNLSEIWDNMTWLQWDKEISNYTQIIYGLLEESQNQQEKNEQDLLALD

SEQ ID NO: 305 - protein, 640 aa, Artificial Sequence
  Recombinant HIV protein
VGNLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSAITQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNISRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQAMYAPPIAGNITCSSNITGLLLERDGGRDINNTEIFRPGGGDMKNNWRSELYKYKVVEIKPLGVAPTTAKRRVVEGGSGGGGSGGAVGIGAVFLGFLGVAGSTMGAASMTLTVQARQLLSGIVQQQSNLLRAPEAQQHMLQLTVWGIKQLQTRVLAIERYLKDQQLLGIWGCSGKLICPTAVPWNSSWSNKSQTEIWNNMTWMQWDKEISNYTNSIYRLLEESQNQQEKNEKDLLALD

SEQ ID NO: 306 - protein, 654 aa, Artificial Sequence
  Recombinant HIV protein
GGNMWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVEIKPLGVAPTEAKRRVVEGGSGGGGSGGAVGIGAVFLGFLGAAGSTMGAASITLTVQARQLLSGIVQQQSNLLRAPEAQQHMLQLTVWGIKQLQTRVLAIERYLKDQQLLGIWGCSGKLICTTAVPWNSSWSNKSHEEIWNNMTWMQWDREISNYTNIIYNLLEESQNQQERNEKDLLALD

SEQ ID NO: 307 - protein, 633 aa, Artificial Sequence
  Recombinant HIV protein
AEQLWVTVYYGVPVWREAKTTLFCASDAKSYEKEVHNVWATHACVPTDPNPQELVLKNVTENFNMWKNDMVDQMHEDIISLWDQSLKPCVKLTPLCVTLNCSDAKVNINATYNGTREEIKNCSFNATTELRDKKKKEYALFYRLDIVPLNKEGNNNSEYRLINCNTSVITQACPKVTFDPIPIHYCAPAGYAILKCNNKTFNGTGPCNNVSTVQCTHGIKPVVSTQLLLNGSLAEEEIIIRSENLTDNVKTIIVHLNESVEINCTRPNNNTRKSIRIGPGQTFYATGDIIGDIRQAHCNISEIKWEKTLQRVSEKLREHFNKTIIFNQSSGGDLEITTHSFNCGGEFFYCNTSDLFFNKTFDETYSTGSNSTNSTITLPCRIKQIINMWQEVGRAMYASPIAGEITCKSNITGLLLTRDGGGNNSTEETFRPGGGNMRDNWRSELYKYKVVEVKPLGIAPTEARRRVVQGGSGGGGSGGAVVGLGAVFLGFLGTAGSTMGAASITLTVQARQLLSGIVQQQSNLLRAPEAQQHMLQLTVWGIKQLQARVLAIERYLKDQQLLGMWGCSGKLICTTNVYWNSSWSNKTYNEIWDNMTWMQWDREIDNYTDTIYKLLEVSQKQQESNEKDLLALD

SEQ ID NO: 308 - protein, 628 aa, Artificial Sequence
  Recombinant HIV protein
TEKLWVTVYYGVPVWKEAKTTLFCASNAKAYEKEVHNIWATHACVPTDPNPQEIVLGNVTENFNMWKNDMVDQMHEDIISLWDQSLKPCVKLTSLCVTLKCSNFTGKSNVTYKGDMEVKNCSFNVTTEIRDKKQKVYALFYRLDITPLDDNSSEYILINCNSSTITQACPKVNFDPIPIHYCAPAGYAILKCNNKTFNGTGPCHNVSTVQCTHGIKPVVSTQLLLNGSLAEGEIIIRSENLTDNVKTIIVHFNESVEITCTRPNNNTRKSISIGPGQAIYATGDIIGDIRQAHCNISKENWNKTLQWVRGKLKEHFPNKTIVFKPSSGGDLEITTHSFNCRGEFFYCNTSKLFNSTDNSTHMGTENNTIITIPCRIKQIINMWQEVGRAMYAPPIEGNITCKSNITGLLLVRDGGWDNSTNDTETFRPGGGDMRDNWRSELYKYKVVEVKPLGIAPTKAKRRVVEGGSGGGGSGGAVGIGAVFLGFLGAAGSTMGAASITLTVQARQLLSGIVQQQDNLLRAPEAQQHMLQLTVWGIKQLQARVLAIERYLQDQQLLGIWGCSGKLICTTAVPWNDSWSNKSQTDIWENMTWMQWDREISRHTDTIYRLLEDSQNQQEKNEKDLLALD

SEQ ID NO: 309 - protein, 620 aa, Artificial Sequence
  Recombinant HIV protein
AGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGGSGGGGSGGAVGLGAMFLGFLGAAGSTMGAASITLTVQARQLLSGIVQQQNNLLRAPEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALD

SEQ ID NO: 310 - protein, 638 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQFQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 311 - protein, 659 aa, Artificial Sequence
  Recombinant HIV protein
TDKLWVTVYYGVPVWKEAVTTLFCASDAKAYDTEVHNVWATHACVPTDPDPQEVVLENVTENFNMWKNNMVEQMHEDIISLWDQSLKPCVKLTPLCVTLNCTDYNNTATNTTSSATTTASSANKTAKEEAVMKNCSFNITTNVRDKVKREYALFYNLDVVKLEEDETSYRLVSCNTSVVTQACPKITFEPIPIHYCAPAGFAILKCNNKTFNGTGPCTNVSTVQCTHGIKPVVSTQLLLNGSLAEGGEVMIRSANFTNNAKTIIVQLSKSVAINCTRPNNNTSKSIHMGPGGAFFATGRIIGDIRKAYCTVNGTEWNTTLRQIVEKFKKQFGENKTIVFKPSAGGDPEIVTHSFNCGGEFFYCNTTNLFNSSSTELNSTWSGNSNDTGKNDTITLPCRIKQIINMWQQVGKAMYAPPISGKINCLSNITGLLLTRDGGSDGGSKNSSKNETGTEIFRPGGGDMRDNWRSELYKYKVVRIEPLGVAPTKAKRRAVQGGSGGGGSGGDLGLGALFLGFLGAAGSTMGAASVTLTVQARQLLSGIVQFQNNLLRAIEAQQHLLQLTVWGIKQLQARLLAVERYLKDQQLLGIWGCSGKLICTTTVPWNNSWSKNKTYEYIWNNMTWIEWEREIDNYTGLIYNLIEKSQNQQEKNEKELLELD

SEQ ID NO: 312 - protein, 646 aa, Artificial Sequence
  Recombinant HIV protein
AEDSWVTVYYGVPVWKEAKTTLFCASDAKAYEREVHNVWATHACVPTDPNPQELVLENVTESFNMWKNDMVDQMHEDIISLWDESLKPCVKLTPLCVTLNCSNAKLNNASNATLNNNSTASNATPTITSIKEIQNCTFNATTVVRDKKSKEYALFYRLDIVPLDNETSMYRLINCNTSVITQACPKVSFDPIPIHYCAPAGYAILKCNNKTFNGTGPCNSVSTVQCTHGIKPVVSTQLLLNGSLAEEEIIIRSENLTNNIKTIIVHLNESVEINCTRLGNNTRRSVRIGPGQTFYATGEIIGDIRKAYCNIRLDDWNKTLHRVSKKLAEHFPNKTIEFTSSSGGDLEITTHSFNCRGEFFYCNTSNLFNSEYMANGTYNFNGEESNSSITLQCRIKQIINMWQEVGRAMYAPPIAGNITCRSNITGLLVTRDGGEKGEKNDTETFRPGGGDMRDNWRSELYKYKVVEIKPLGIAPTKAKRRVVQGGSGGGGSGGAALGAVFLGFLGAAGSTMGAASLTLTVQARQLLSGIVQFQSNLLRAIEAQQHMLQLTVWGIKQLQARVLALERYLRDQQLLGMWGCSGKLICTTAVPWNASWSNRNLSSIWNNMTWMQWEREISNYSDTIYRLLEESQNQQETNEKDLLELD

SEQ ID NO: 313 - protein, 626 aa, Artificial Sequence
  Recombinant HIV protein
TEKLWVTVYYGVPVWREAKATLFCASDAKAYDTEVHNVWATHACVPTDPNPQEIILENVTENFNMWKNNMVEQMHEDIISLWDQSLKPCVKLTPLCVTLNCTDVTVNGTIVKVNSTGMKNCSFNITTEIRDKKKKESALFYRLDIVPLDESSDSSSNYSEYRLISCNTSTITQACPKVTFDPIPIHYCAPAGYAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRAIYAPPIAGNITCTSDITGLLLTRDGGSDGNSTKETFRPGGGDMRDNWRSELYKYKVVEIKPLGVAPTKAKRRVVEGGSGGGGSGGAVGIGAVFFGFLGAAGSTMGAASITLTVQARQLLSGIVQFQSNLLRAIEAQQHMLQLTVWGIKQLQTRVLAIERYLKDQQLLGIWGCSGKLICTTTVPWNSSWSNKTQNDIWDNMTWMQWDREINNYTNTIYRLLEESQNQQEKNEQDLLALD

SEQ ID NO: 314 - protein, 636 aa, Artificial Sequence
  Recombinant HIV protein
GGNLWVTVYYGVPVWKEAKTTLFCASDAKAYEREVHNVWATHACVPTDPNPQEMVLENVTENFNMWKNDMVDQMHEDIISLWDQSLKPCVKLTPLCVTLKCGNVTKNNTVTTNDTLNGEIKNCSFNITTELRDKKKNVSALFYSLDIVPLKNESENEYRLISCNTSTITQACPKVSFDPIPIHYCAPAGYAILKCNNNTFNGTGPCNNVSTVQCTHGIKPVVSTQLLLNGSLAKEGIVIRSENLTNNVKTIIVQFKTPVKIVCTRPNNNTRKSVRIGPGQTFYATGDIIGNIRQAHCNISEETWNQTLQNLVTKLKEHFPNKTIQFKPSSGGDLEITTHSFNCRGEFFYCNTSKLFNSTYMANNTDVSNSTLNSTSNATITLPCRIKQIINMWQGVGRAMYAPPIAGNITCKSNITGVLLTRDGGESNGTEEVFRPGGGDMRDNWRSELYKYKVVEIKPLGIAPTGAKRRVVEGGSGGGGSGGAVGIGAVFLGFLGAAGSTMGAASITLTVQARQLLSGIVQFQSNLLRAIEAQQHLLQLTVWGIKQLQTRVLAIERYLKDQQLLGIWGCSGKLICTTNVPWNSSWSNKSQTDIWNNMTWMQWDKEINNYTNTIYRLLEESQNQQEKNEKDLLALD

SEQ ID NO: 315 - protein, 634 aa, Artificial Sequence
  Recombinant HIV protein
VGNLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVEIKPLGVAPTAAKRRVVQGGSGGGGSGGAVGLGAVFLGFLGAAGSTMGAASITLTVQARQLLSGIVQFQSNLLRAIEAQQHMLQLTVWGIKQLQTRVLAIERYLKDQQLLGIWGCSGKLICTTAVPWNTSWSNRSQADIWGNMTWMQWDREISNYTNTIFRLLEDSQIQQESNEKDLLALD

SEQ ID NO: 316 - protein, 643 aa, Artificial Sequence
  Recombinant HIV protein
MGNLWVTVYYGVPVWKEAKTTLFCASDAKGYDTEVHNVWATHACVPTDPNPQEIVLENVTENFNMWKNDMVDQMHQDIISLWDQSLKPCVKLTPLCVTLNCSDATYNNGTNSTDTMKICSFNATTELRDKKKKEYALFYRLDIVPLKNESESQNFSEYILINCNTSTIAQACPKVSFDPIPIHYCAPAGYAILKCNNKTFNGTGPCNNVSTVQCTHGIKPVVSTQLLLNGSLAEEEVVIRSENISNNVKTIIVHLNESVNITCIRPGNNTRRSIRIGPGQAFYAMGDIIGNIREAHCNISEKAWNETLKKVVEKLVKYFPNKTIEFAPPVGGDLEITTHSFNCGGEFFYCNTTKLFNSTHNSTDSTVNSTDSTAETGNSTNTNITLPCRIRQIINMWQEVGRAMYAPPSKGNITCISNITGLLLTRDGGENKTENNDTEIFRPGGGDMKDNWRSELYKYKVVEIKPLGVAPTRAKRRVVEGGSGGGGSGGAVGIGAVFLGFLGAAGSTMGAASITLTVQARQLLSGIVQFQSNLLRAIEAQQHMLQLTVWGIKQLQTRVLAIERYLKDQQLLGIWGCSGKLICTTNVPWNSSWSNKSYGDIWDNMTWMQWDREINNYTNTIYRLLEDSQNQQEKNEQDLLALD

SEQ ID NO: 317 - protein, 654 aa, Artificial Sequence
  Recombinant HIV protein
GGNMWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVEIKPLGVAPTEAKRRVVEGGSGGGGSGGAVGIGAVFLGFLGAAGSTMGAASITLTVQARQLLSGIVQQQSNLLRAPEAQQHMLQLTVWGIKQLQTRVLAIERYLKDQQLLGIWGCSGKLICTTAVPWNSSWSNKSHEEIWNNMTWMQWDREISNYTNIIYNLLEESQNQQERNEKDLLALD

SEQ ID NO: 318 - protein, 654 aa, Artificial Sequence
  Recombinant HIV protein
GGNMWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVEIKPLGVAPTEAKRRVVEGGSGGGGSGGAVGIGAVFLGFLGAAGSTMGAASITLTVQARQLLSGIVQFQSNLLRAIEAQQHMLQLTVWGIKQLQTRVLAIERYLKDQQLLGIWGCSGKLICTTAVPWNSSWSNKSHEEIWNNMTWMQWDREISNYTNIIYNLLEESQNQQERNEKDLLALD

SEQ ID NO: 319 - protein, 659 aa, Artificial Sequence
  Recombinant HIV protein
TDKLWVTVYYGVPVWKEAVTTLFCASDAKAYDTEVHNVWATHACVPTDPDPQEVVLENVTENFNMWKNNMVEQMHEDIISLWDQSLKPCVKLTPLCVTLNCTDYNNTATNTTSSATTTASSANKTAKEEAVMKNCSFNITTNVRDKVKREYALFYNLDVVKLEEDETSYRLVSCNTSVVTQACPKITFEPIPIHYCAPAGFAILKCNNKTFNGTGPCTNVSTVQCTHGIKPVVSTQLLLNGSLAEGGEVMIRSANFTNNAKTIIVQLSKSVAINCTRPNNNTSKSIHMGPGGAFFATGRIIGDIRKAYCTVNGTEWNTTLRQIVEKFKKQFGENKTIVFKPSAGGDPEIVTHSFNCGGEFFYCNTTNLFNSSSTELNSTWSGNSNDTGKNDTITLPCRIKQIINMWQQVGKAMYAPPISGKINCLSNITGLLLTRDGGSDGGSKNSSKNETGTEIFRPGGGDMRDNWRSELYKYKVVRIEPLGVAPTKAKRRAVQGGSGGGGSGGDLGLGALFLGFLGAAGSTMGAASVTLTVQARQLLSGIVQQQNNLLRAPEAQQHLLQLTVWGIKQLQARLLAVERYLKDQQLLGIWGCSGKLICTTTVPWNNSWSKNKTYEYIWNNMTWIEWEREIDNYTGLIYNLIEKSQNQQEKNEKELLELD

SEQ ID NO: 320 - protein, 634 aa, Artificial Sequence
  Recombinant HIV protein
VGNLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVEIKPLGVAPTAAKRRVVQGGSGGGGSGGAVGLGAVFLGFLGAAGSTMGAASITLTVQARQLLSGIVQQQSNLLRAPEAQQHMLQLTVWGIKQLQTRVLAIERYLKDQQLLGIWGCSGKLICTTAVPWNTSWSNRSQADIWGNMTWMQWDREISNYTNTIFRLLEDSQIQQESNEKDLLALD

SEQ ID NO: 321 - protein, 643 aa, Artificial Sequence
  Recombinant HIV protein
MGNLWVTVYYGVPVWKEAKTTLFCASDAKGYDTEVHNVWATHACVPTDPNPQEIVLENVTENFNMWKNDMVDQMHQDIISLWDQSLKPCVKLTPLCVTLNCSDATYNNGTNSTDTMKICSFNATTELRDKKKKEYALFYRLDIVPLKNESESQNFSEYILINCNTSTIAQACPKVSFDPIPIHYCAPAGYAILKCNNKTFNGTGPCNNVSTVQCTHGIKPVVSTQLLLNGSLAEEEVVIRSENISNNVKTIIVHLNESVNITCIRPGNNTRRSIRIGPGQAFYAMGDIIGNIREAHCNISEKAWNETLKKVVEKLVKYFPNKTIEFAPPVGGDLEITTHSFNCGGEFFYCNTTKLFNSTHNSTDSTVNSTDSTAETGNSTNTNITLPCRIRQIINMWQEVGRAMYAPPSKGNITCISNITGLLLTRDGGENKTENNDTEIFRPGGGDMKDNWRSELYKYKVVEIKPLGVAPTRAKRRVVEGGSGGGGSGGAVGIGAVFLGFLGAAGSTMGAASITLTVQARQLLSGIVQQQSNLLRAPEAQQHMLQLTVWGIKQLQTRVLAIERYLKDQQLLGIWGCSGKLICTTNVPWNSSWSNKSYGDIWDNMTWMQWDREINNYTNTIYRLLEDSQNQQEKNEQDLLALD

SEQ ID NO: 322 - protein, 636 aa, Artificial Sequence
  Recombinant HIV protein
GGNLWVTVYYGVPVWKEAKTTLFCASDAKAYEREVHNVWATHACVPTDPNPQEMVLENVTENFNMWKNDMVDQMHEDIISLWDQSLKPCVKLTPLCVTLKCGNVTKNNTVTTNDTLNGEIKNCSFNITTELRDKKKNVSALFYSLDIVPLKNESENEYRLISCNTSTITQACPKVSFDPIPIHYCAPAGYAILKCNNNTFNGTGPCNNVSTVQCTHGIKPVVSTQLLLNGSLAKEGIVIRSENLTNNVKTIIVQFKTPVKIVCTRPNNNTRKSVRIGPGQTFYATGDIIGNIRQAHCNISEETWNQTLQNLVTKLKEHFPNKTIQFKPSSGGDLEITTHSFNCRGEFFYCNTSKLFNSTYMANNTDVSNSTLNSTSNATITLPCRIKQIINMWQGVGRAMYAPPIAGNITCKSNITGVLLTRDGGESNGTEEVFRPGGGDMRDNWRSELYKYKVVEIKPLGIAPTGAKRRVVEGGSGGGGSGGAVGIGAVFLGFLGAAGSTMGAASITLTVQARQLLSGIVQQQSNLLRAPEAQQHLLQLTVWGIKQLQTRVLAIERYLKDQQLLGIWGCSGKLICTTNVPWNSSWSNKSQTDIWNNMTWMQWDKEINNYTNTIYRLLEESQNQQEKNEKDLLALD

SEQ ID NO: 323 - protein, 626 aa, Artificial Sequence
  Recombinant HIV protein
TEKLWVTVYYGVPVWREAKATLFCASDAKAYDTEVHNVWATHACVPTDPNPQEIILENVTENFNMWKNNMVEQMHEDIISLWDQSLKPCVKLTPLCVTLNCTDVTVNGTIVKVNSTGMKNCSFNITTEIRDKKKKESALFYRLDIVPLDESSDSSSNYSEYRLISCNTSTITQACPKVTFDPIPIHYCAPAGYAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRAIYAPPIAGNITCTSDITGLLLTRDGGSDGNSTKETFRPGGGDMRDNWRSELYKYKVVEIKPLGVAPTKAKRRVVEGGSGGGGSGGAVGIGAVFFGFLGAAGSTMGAASITLTVQARQLLSGIVQQQSNLLRAPEAQQHMLQLTVWGIKQLQTRVLAIERYLKDQQLLGIWGCSGKLICTTTVPWNSSWSNKTQNDIWDNMTWMQWDREINNYTNTIYRLLEESQNQQEKNEQDLLALD

SEQ ID NO: 324 - protein, 646 aa, Artificial Sequence
  Recombinant HIV protein
AEDSWVTVYYGVPVWKEAKTTLFCASDAKAYEREVHNVWATHACVPTDPNPQELVLENVTESFNMWKNDMVDQMHEDIISLWDESLKPCVKLTPLCVTLNCSNAKLNNASNATLNNNSTASNATPTITSIKEIQNCTFNATTVVRDKKSKEYALFYRLDIVPLDNETSMYRLINCNTSVITQACPKVSFDPIPIHYCAPAGYAILKCNNKTFNGTGPCNSVSTVQCTHGIKPVVSTQLLLNGSLAEEEIIIRSENLTNNIKTIIVHLNESVEINCTRLGNNTRRSVRIGPGQTFYATGEIIGDIRKAYCNIRLDDWNKTLHRVSKKLAEHFPNKTIEFTSSSGGDLEITTHSFNCRGEFFYCNTSNLFNSEYMANGTYNFNGEESNSSITLQCRIKQIINMWQEVGRAMYAPPIAGNITCRSNITGLLVTRDGGEKGEKNDTETFRPGGGDMRDNWRSELYKYKVVEIKPLGIAPTKAKRRVVQGGSGGGGSGGAALGAVFLGFLGAAGSTMGAASLTLTVQARQLLSGIVQQQSNLLRAPEAQQHMLQLTVWGIKQLQARVLALERYLRDQQLLGMWGCSGKLICTTAVPWNASWSNRNLSSIWNNMTWMQWEREISNYSDTIYRLLEESQNQQETNEKDLLELD

SEQ ID NO: 325 - protein, 633 aa, Artificial Sequence
  Recombinant HIV protein
GREDLWVTVYYGVPVWKEAKTTLFCASDAKAHEREVHNVWATYACVPTDPNPQEIVLKNVTENFNMWENDMVDQMQEDVISLWDQSLKPCIKLTPLCVTLECTNVNIINGTIHNETYESMKNCSFNTTTELKDKKQSVYALFYRLDIVPLNNSNEYYRLINCNTSAIKQACPKVTFDPIPIHYCAPAGYAILKCNDKTFSGTGPCHNVSTVQCTHGIKPVVSTQLLLNGSLAEGEIIIRSKKLDDNANTIIVHLDEPVKIECTRPNNNTRKSIRIGPGQTFYATGEIIGNIRQAHCNISEDQWNETLQRVGKKLAELFPNKTITFNSSSGGDLEITTHSFNCRGEFFYCNTSSLFKGTYRPNGTSNSTSGSIITLPCYIKQVINLWQEVGRAIYAPPIEGNITCISNITGLLLVRDGGNHEEANTTETFRPGGGNMRDNWRSELYKYKVVEIKPLGVAPTKARRRVVEGGSGGGGSGGAVGVGAVMFLGFLGAAGSTMGAASITLTVQARQLLSGIVQQQSNLLKAPEAQQHLLQLTVWGIKQLQTRVLAIERYLKDQQLLGIWGCSGKLICTTSVPWNSSWSNNRSQDDIWENMTWMQWDREISNYTNTIYRLLEDSQNQQENNEKDLLALD

SEQ ID NO: 326 - protein, 625 aa, Artificial Sequence
  Recombinant HIV protein
VGNLWVTVYYGVPVWREATTTLFCASDAKGYEREVHNVWATHACVPTDPNPQEIVLKNVTENFNMWKNDMVDQMHEDIISLWEQSLKPCVKLTPLCVTLICRNVNLTNNNSISGNDSMSGEMRNCSFNMTTELRDKKKNVSALFYKLDVVPIDGRENNSEYRLINCNTSAITQACPKVSFDPIPIHYCAPAGYAILKCNNETFNGTGPCRNVSTVQCTHGIKPVVSTQLLLNGSLAEKDIMIRSENLTNNAKIIIVHLNESIEIKCIRPGNNTRQSIRIGPGQAFYAYTNIIGDIRKAHCNISGTKWNETLEKVKSILREFFNKTVKFQPHSGGDLEVVTHSFNCRGEFFYCNTSQLFNETHTNGTNSTIILPCRIKQIINMWQEVGRAMYAPPIAGNITCTSNITGLLLERDGGKDNNMTEIFRPGGGDMRDNWRSELYKYKVVEIKPLGVAPTKAKRRVVEGGSGGGGSGGAALGAVFLGFLGAAGSTMGAASITLTVQARQLLSGIVQQQSNLLRAPEAQQHLLQLTVWGIKQLQTRVLAIERYLKDQQLLGIWGCSGKLICTTNVPWNSSWSNKSQEEIWDNMTWIQWDREVSNYTDTIYRLLEDSQNQQEKNEKDLLALD

SEQ ID NO: 327 - protein, 620 aa, Artificial Sequence
  Recombinant HIV protein
AGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGGSGGGGSGGAVGLGAMFLGFLGAAGSTMGAASITLTVQARQLLSGIVQQQNNLLRAPEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALD

SEQ ID NO: 328 - protein, 625 aa, Artificial Sequence
  Recombinant HIV protein
AGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGGSGGGGSGGGGSGGAVGLGAMFLGFLGAAGSTMGAASITLTVQARQLLSGIVQQQNNLLRAPEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALD

SEQ ID NO: 329 - protein, 630 aa, Artificial Sequence
  Recombinant HIV protein
AGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGGSGGGGSGGGGSGGGGSGGAVGLGAMFLGFLGAAGSTMGAASITLTVQARQLLSGIVQQQNNLLRAPEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALD

SEQ ID NO: 330 - protein, 617 aa, Artificial Sequence
  Recombinant HIV protein
AGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGGSGGSGAVGLGAMFLGFLGAAGSTMGAASITLTVQARQLLSGIVQQQNNLLRAPEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALD

SEQ ID NO: 331 - protein, 620 aa, Artificial Sequence
  Recombinant HIV protein
AGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGGSGGGGSGGAVGLGAMFLGFLGAAGSTMGAASITLTVQARQLLSGIVQQQNNLLRAIEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALD

SEQ ID NO: 332 - protein, 625 aa, Artificial Sequence
  Recombinant HIV protein
AGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGGSGGGGSGGGGSGGAVGLGAMFLGFLGAAGSTMGAASITLTVQARQLLSGIVQQQNNLLRAIEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALD

SEQ ID NO: 333 - protein, 630 aa, Artificial Sequence
  Recombinant HIV protein
AGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGGSGGGGSGGGGSGGGGSGGAVGLGAMFLGFLGAAGSTMGAASITLTVQARQLLSGIVQQQNNLLRAIEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALD

SEQ ID NO: 334 - protein, 617 aa, Artificial Sequence
  Recombinant HIV protein
AGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVGGGSGGSGAVGLGAMFLGFLGAAGSTMGAASITLTVQARQLLSGIVQQQNNLLRAIEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALD

SEQ ID NO: 335 - protein, 622 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGGFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 336 - protein, 627 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGGGGSGGFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 337 - protein, 632 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGGGGSGGGGSGGFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 338 - protein, 637 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGGGGSGGGGSGGGGSGGFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 339 - protein, 623 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGSGGFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 340 - protein, 628 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGSGGGGSGGFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 341 - protein, 633 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGSGGGGSGGGGSGGFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 342 - protein, 638 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGSGGGGSGGGGSGGGGSGGFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 343 - protein, 619 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 344 - protein, 624 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGGGGSGGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 345 - protein, 629 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGGGGSGGGGSGGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 346 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGGSGGGGSGGGGSGGGGSGGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 347 - protein, 620 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGSGGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 348 - protein, 625 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGSGGGGSGGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 349 - protein, 630 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGSGGGGSGGGGSGGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 350 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGSGGGGSGGGGSGGGGSGGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 351 - protein, 633 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 352 - protein, 638 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 353 - protein, 643 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 354 - protein, 648 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGGSGGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 355 - protein, 620 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRGGSGGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 356 - protein, 625 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRGGSGGGGSGGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 357 - protein, 630 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRGGSGGGGSGGGGSGGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 358 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRGGSGGGGSGGGGSGGGGSGGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 359 - protein, 619 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 360 - protein, 622 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGSGGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 361 - protein, 626 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGSGGGSGGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 362 - protein, 631 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGGSGGGSGGGSGGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 363 - protein, 616 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 364 - protein, 620 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGSGAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 365 - protein, 624 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGSGGGSGAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 366 - protein, 629 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGGSGGGSGGGSGAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 367 - protein, 624 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGATGSGAGGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 368 - protein, 628 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGASGTGAGGSGGSGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 369 - protein, 622 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGSGGSGGGSGAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 370 - protein, 627 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRGGSGGGSGGGSGGGSGAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 371 - protein, 622 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCCTLQCTNVTNNITDDMRGELKNCSFNMTTELCDKKQKVYSLFYRLDVVQINENQGNRSNNSNKEYRLINCNTCAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRICPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGSGGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 372 - protein, 626 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCCTLQCTNVTNNITDDMRGELKNCSFNMTTELCDKKQKVYSLFYRLDVVQINENQGNRSNNSNKEYRLINCNTCAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRICPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGSGGGSGGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 373 - protein, 806 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 374 - protein, 811 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGGGSGGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 375 - protein, 816 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGGGSGGGGSGGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 376 - protein, 806 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQFQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 377 - protein, 811 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQFQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGGGSGGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 378 - protein, 816 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQFQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGGGSGGGGSGGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 379 - protein, 628 aa, Artificial Sequence
  Recombinant HIV protein
AENLWVTVYYGVPVWREAKTTLFCASDAKSYEKEVHNVWATHACVPTDPNPQELVLKNVTENFNMWKNDMVDQMHEDIISLWDQSLKPCVKLTPLCVTLNCSDAKVNINATYNGTREEIKNCSFNATTELRDKKKKEYALFYRLDIVPLNKEGNNNSEYRLINCNTSVITQACPKVTFDPIPIHYCAPAGYAILKCNNKTFNGTGPCNNVSTVQCTHGIKPVVSTQLLLNGSLAEEEIIIRSENLTDNVKTIIVHLNESVEINCTRPNNNTRKSIRIGPGQTFYATGDIIGDIRQAHCNISEIKWEKTLQRVSEKLREHFNKTIIFNQSSGGDLEITTHSFNCGGEFFYCNTSDLFFNKTFDETYSTGSNSTNSTITLPCRIKQIINMWQEVGRAMYASPIAGEITCKSNITGLLLTRDGGGNNSTEETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 380 - protein, 624 aa, Artificial Sequence
  Recombinant HIV protein
AENLWVTVYYGVPVWKEAKTTLFCASNAKAYEKEVHNIWATHACVPTDPNPQEIVLGNVTENFNMWKNDMVDQMHEDIISLWDQSLKPCVKLTSLCVTLKCSNFTGKSNVTYKGDMEVKNCSFNVTTEIRDKKQKVYALFYRLDITPLDDNSSEYILINCNSSTITQACPKVNFDPIPIHYCAPAGYAILKCNNKTFNGTGPCHNVSTVQCTHGIKPVVSTQLLLNGSLAEGEIIIRSENLTDNVKTIIVHFNESVEITCTRPNNNTRKSISIGPGQAIYATGDIIGDIRQAHCNISKENWNKTLQWVRGKLKEHFPNKTIVFKPSSGGDLEITTHSFNCRGEFFYCNTSKLFNSTDNSTHMGTENNTIITIPCRIKQIINMWQEVGRAMYAPPIEGNITCKSNITGLLLVRDGGWDNSTNDTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 381 - protein, 636 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSAITQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNISRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQAMYAPPIAGNITCSSNITGLLLERDGGRDINNTEIFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 382 - protein, 650 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 383 - protein, 630 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 384 - protein, 622 aa, Artificial Sequence
  Recombinant HIV protein
AENLWVTVYYGVPVWREAKATLFCASDAKAYDTEVHNVWATHACVPTDPNPQEIILENVTENFNMWKNNMVEQMHEDIISLWDQSLKPCVKLTPLCVTLNCTDVTVNGTIVKVNSTGMKNCSFNITTEIRDKKKKESALFYRLDIVPLDESSDSSSNYSEYRLISCNTSTITQACPKVTFDPIPIHYCAPAGYAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRAIYAPPIAGNITCTSDITGLLLTRDGGSDGNSTKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 385 - protein, 616 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 386 - protein, 616 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 387 - protein, 630 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGSGGDLALLDQENKEQQNQSEELLGYIIQTYNSIEKDWQLWTMNDWIESLNRNSWSSNWPVNTTCILKGSCGWIGLLQQDRLYREVALVRAQLQKIGWVTLKLLHQQAEPARLLNSQQQVIGSLLNRAQVTLTMSAAGMTSGAAGLFGLFVA

SEQ ID NO: 388 - protein, 628 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGSDLALLDQENKEQQNQSEELLGYIIQTYNSIEKDWQLWTMNDWIESLNRNSWSSNWPVNTTCILKGSCGWIGLLQQDRLYREVALVRAQLQKIGWVTLKLLHQQAEPARLLNSQQQVIGSLLNRAQVTLTMSAAGMTSGAAGLFGLFVA

SEQ ID NO: 389 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGSGGSGGSDLALLDQENKEQQNQSEELLGYIIQTYNSIEKDWQLWTMNDWIESLNRNSWSSNWPVNTTCILKGSCGWIGLLQQDRLYREVALVRAQLQKIGWVTLKLLHQQAEPARLLNSQQQVIGSLLNRAQVTLTMSAAGMTSGAAGLFGLFVA

SEQ ID NO: 390 - protein, 510 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRGGNTTCILKGSCGWIGLLQQDRLYREVALVRAQLQKIGW

SEQ ID NO: 391 - protein, 508 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKGGTTCILKGSCGWIGLLQQDRLYREVALVRAQLQKIGW

SEQ ID NO: 392 - protein, 509 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKGGSTTCILKGSCGWIGLLQQDRLYREVALVRAQLQKIGW

SEQ ID NO: 393 - protein, 563 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKGGSTTCILKGSCGWIGLLQQDRLYREVALVRAQLQKIGWVTLKLLHQQAEPARLLNSQQQVIGSLLNRAQVTLTMSAAGMTSGAAGLFGLFVA

SEQ ID NO: 394 - protein, 562 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKGGTTCILKGSCGWIGLLQQDRLYREVALVRAQLQKIGWVTLKLLHQQAEPARLLNSQQQVIGSLLNRAQVTLTMSAAGMTSGAAGLFGLFVA

SEQ ID NO: 395 - protein, 630 aa, Artificial Sequence
  Recombinant HIV protein
QLAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDGGSGGSVVRRKARTPAVGLPEIKVVKYKYLESRWNDRMDGGGPRFTETTSNTSGGDRTLILGTINSVCRIVGQIPPAYMAQGIRQWMNIIQKIRCPLTISDNSGTSNSGQVSTNSIWTSNFLGSTNCYFFEGGCNFSHTTVELDGGSSNAFRIITNNGFHKRLQKVVKGLTENWTAKSVNCHAQRIDGIIDGTAYFAQGPGIRISKRTNNNPRTCNIQVPTNFQVLINKANNTINESRIMVEEEALSGNLLLQTSVVPKIGHTCQVTSVSPCPGTGNFKKDKCKLIAFGAPACYHIPIPEFSVKPCAQTIASTNCNILRYEKNSNNSRNGQNENIQVVDLRYFLSYVKQKKDRLETTMNFSCNKLEGRMDDTINNTVNTCQLTVCLPTLKVCPKLSQDWLSIIDTHMQEVMNNKWMNFEETVNELHIEQPNPDTPVCAHTAWVNHKETEYAKADSACFLTTEADKWVPVGYYVTVWLNEA

SEQ ID NO: 396 - protein, 636 aa, Artificial Sequence
  Recombinant HIV protein
QLAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDGGSGGSGGSGGSVVRRKARTPAVGLPEIKVVKYKYLESRWNDRMDGGGPRFTETTSNTSGGDRTLILGTINSVCRIVGQIPPAYMAQGIRQWMNIIQKIRCPLTISDNSGTSNSGQVSTNSIWTSNFLGSTNCYFFEGGCNFSHTTVELDGGSSNAFRIITNNGFHKRLQKVVKGLTENWTAKSVNCHAQRIDGIIDGTAYFAQGPGIRISKRTNNNPRTCNIQVPTNFQVLINKANNTINESRIMVEEEALSGNLLLQTSVVPKIGHTCQVTSVSPCPGTGNFKKDKCKLIAFGAPACYHIPIPEFSVKPCAQTIASTNCNILRYEKNSNNSRNGQNENIQVVDLRYFLSYVKQKKDRLETTMNFSCNKLEGRMDDTINNTVNTCQLTVCLPTLKVCPKLSQDWLSIIDTHMQEVMNNKWMNFEETVNELHIEQPNPDTPVCAHTAWVNHKETEYAKADSACFLTTEADKWVPVGYYVTVWLNEA

SEQ ID NO: 397 - protein, 633 aa, Artificial Sequence
  Recombinant HIV protein
QLAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDGGSGGSGGSVVRRKARTPAVGLPEIKVVKYKYLESRWNDRMDGGGPRFTETTSNTSGGDRTLILGTINSVCRIVGQIPPAYMAQGIRQWMNIIQKIRCPLTISDNSGTSNSGQVSTNSIWTSNFLGSTNCYFFEGGCNFSHTTVELDGGSSNAFRIITNNGFHKRLQKVVKGLTENWTAKSVNCHAQRIDGIIDGTAYFAQGPGIRISKRTNNNPRTCNIQVPTNFQVLINKANNTINESRIMVEEEALSGNLLLQTSVVPKIGHTCQVTSVSPCPGTGNFKKDKCKLIAFGAPACYHIPIPEFSVKPCAQTIASTNCNILRYEKNSNNSRNGQNENIQVVDLRYFLSYVKQKKDRLETTMNFSCNKLEGRMDDTINNTVNTCQLTVCLPTLKVCPKLSQDWLSIIDTHMQEVMNNKWMNFEETVNELHIEQPNPDTPVCAHTAWVNHKETEYAKADSACFLTTEADKWVPVGYYVTVWLNEA

SEQ ID NO: 398 - protein, 590 aa, Artificial Sequence
  Recombinant HIV protein
GFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLGAGVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTR

SEQ ID NO: 399 - protein, 589 aa, Artificial Sequence
  Recombinant HIV protein
GFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLGGVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTR

SEQ ID NO: 400 - protein, 591 aa, Artificial Sequence
  Recombinant HIV protein
GFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLGGGTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTR

SEQ ID NO: 401 - protein, 591 aa, Artificial Sequence
  Recombinant HIV protein
GFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLGAGTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTR

SEQ ID NO: 402 - protein, 590 aa, Artificial Sequence
  Recombinant HIV protein
GFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLGGTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTR

SEQ ID NO: 403 - protein, 584 aa, Artificial Sequence
  Recombinant HIV protein
GSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLGGGVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTR

SEQ ID NO: 404 - protein, 583 aa, Artificial Sequence
  Recombinant HIV protein
GSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLGGVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTR

SEQ ID NO: 405 - protein, 611 aa, Artificial Sequence
  Recombinant HIV protein
WKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRGSGLWVTVYYGVPVGSGGAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 406 - protein, 615 aa, Artificial Sequence
  Recombinant HIV protein
WKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKGGSGGLWVTVYYGVPVGSGGAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 407 - protein, 611 aa, Artificial Sequence
  Recombinant HIV protein
WKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRGSGLWVTVYYGVPGSGGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 408 - protein, 615 aa, Artificial Sequence
  Recombinant HIV protein
WKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKGGSGGLWVTVYYGVPGSGGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 409 - protein, 634 aa, Artificial Sequence
  Recombinant HIV protein
AENLWVTVYYGVPVWKDAETTLFCASDAKAYETEKHNVWATHACVPTDPNPQEIHLENVCEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 410 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGCCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 411 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSCMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 412 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWCNMTWLQWDKEISNYTQIIYGLLEESQNQQEKNEQDLLALD

SEQ ID NO: 413 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDCMTWLQWDKEISNYTQIIYGLLEESQNQQEKNEQDLLALD

SEQ ID NO: 414 - protein, 131 aa, Artificial Sequence
  madified antibody sequence
QGQLVQSGAELKKPGASVKISCKTSGYRFNFYHINWIRQTAGRGPEWMGWISPYSGDKNLAPAFQDRVIMTTDTEVCVTSFTSTGAAYMEIRNLKFDDTGTYFCAKGLLRDGSSTWLPYLWGQGTLLTVSS

SEQ ID NO: 415 - protein, 131 aa, Artificial Sequence
  modified antibody sequence
QGQLVQSGAELKKPGASVKISCKTSGYRFNFYHINWIRQTAGRGPEWMGWISPYSGDKNLAPAFQDRVIMTTDTEVPVTCFTSTGAAYMEIRNLKFDDTGTYFCAKGLLRDGSSTWLPYLWGQGTLLTVSS

SEQ ID NO: 416 - protein, 131 aa, Artificial Sequence
  modified antibody sequence
QGQLVQSGAELKKPGASVKISCKTSGYRFNFYHINWIRQTAGRGPEWMGWISPYSGDKNLAPAFQDRVIMTTDTEVPVTSFTSTGAAYMEIRNLKFDDTGTYFCAKGLCRDGSSTWLPYLWGQGTLLTVSS

SEQ ID NO: 417 - protein, 131 aa, Artificial Sequence
  modified antibody sequence
QGQLVQSGAELKKPGASVKISCKTSGYRFNFYHINWIRQTAGRGPEWMGWISPYSGDKNLAPAFQDRVIMTTDTEVPVTSFTSTGAAYMEIRNLKFDDTGTYFCAKGLLRCGSSTWLPYLWGQGTLLTVSS

SEQ ID NO: 418 - protein, 131 aa, Artificial Sequence
  modified antibody sequence
QGQLVQSGAELKKPGASVKISCKTSGYRFNFYHINWIRQTAGRGPEWMGWISPYSGDKNLAPAFQDRVIMTTDTEVPVTSFTSTGAAYMEIRNLKFDDTGTYFCAKGLLRDCSSTWLPYLWGQGTLLTVSS

SEQ ID NO: 419 - protein, 653 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWCNMTWLQWDKEISNYTQIIYGLLEESQNQQEKNEQDLLALDGSGSGGSGGSAWSHPQFEK

SEQ ID NO: 420 - protein, 655 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGCSTNSTTETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKGGLEVLFQGPSAWSHPQFEK

SEQ ID NO: 421 - protein, 648 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGCINENGTEIFRPGGGDMRDNWRSELYKYKVVKIEPLGVAPTKAKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELDGGLEVLFQGPSAWSHPQFEK

SEQ ID NO: 422 - protein, 639 aa, Artificial Sequence
  Recombinant HIV protein
ADNLWVTVYYGVPVWKDAETTLFCASDAKAYETEKHNVWATHACVPTDPNPQEMDLENVIEEFNMWKNNMVEQMHTDVISLWDQSLKPCVKLTPLCVTLDCSNHKSIMGEEVKNCSFNMTTELRDKKQKVYSLFYKLDVVPLDEANGNNNSSYRLVNCNTSAITQACPKVTFEPIPIHYCAPAGFAILKCKDKEFSGTGPCKNVSTVQCTHGIKPVVSTQLLLNGSLAEEHVMIRSENITNNAKNILVQLNESVEIYCIRPSNNTRKSVRIGPGQTFYATGEIVGDIRQAHCNVSGSKWNKTLQQVADQLRKHFNTTTIIFANPLGGDLEITTHSFNCGGEFFYCNTSGLFNSTWPSSTQESSDPITLQCRIKQIINMWQRVGQAMYAPPIQGEIRCNSSITGIILTRDGCYNNTNETFRPGGGDMRDNWRSELYKYKVVKIEPLGVAPTKCRRRVVGRRRRRRAVTMGAVFLGFLGAAGSTMGAASLTLTVQARLLLSGIVQQQSNLLRAPEAQQQLLKLTVWGIKQLQARVLAVERYLRDQQLLGIWGCSGKLICCTNVPWNSSWSNKSYSEIWDNMTWLQWDKEVSNYTDIIYKLLEDSQNQQEKNEQDLLALDKGGGLVPRGGGGSAWSHPQFEK

SEQ ID NO: 423 - protein, 653 aa, Artificial Sequence
  Recombinant HIV protein
AEDLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQAMYAPPIQGVIRCQSNITGILLTRDGCNTGNNSRTNETFRPGGGDMRDNWRSELYKYKVVKIEPLGVAPTKCKRRVVGRRRRRRAVGLGAVFIGFLGAAGSTMGAASITLTVQARQLLSGIVQQQSNLLRAPEAQQHLLKLTVWGIKQLQARVLAVERYLKDQQLLGIWGCSGKLICCTNVPWNSSWSNKSYNEIWENMTWLQWDKEINNYTELIYSLIEESQNQQEKNEQDLLALDKGGGLVPRGGGGSAWSHPQFEK

SEQ ID NO: 424 - protein, 649 aa, Artificial Sequence
  Recombinant HIV protein
ADNLWVTVYYGVPVWRDADTTLFCASDAKAQETEAHNIWATHACVPTDPNPQEIHLENVTENFNMWKNNMVEQMQEDVISLWDQSLKPCVKLTPLCVTLNCTTAKVINATIPANVSNIMGNITDEVRNCSFNMTTELRDRKQKAYALFYKLDIVQIKDNKNSSSEYRLINCNTSVIKQACPKVSFDPIPIHYCTPAGYALLKCNDKNFNGTGPCNNVSSVQCTHGIKPVVSTQLLLNGSLAEEEIIISSENLTNNAKTIIVHLNKSVEINCTRPSVNTRTSMHIGPGQVLYRTGDIIGDIRNAYCEIDGTKWSEALELVTEKLKKHFSEIKFQPPSGGDLEITMHHFNCKGEFFYCNTSQLFNNNHKECNGTITLPCRIKQIINMWQGAGQAMYAPPISGKINCVSNITGILLTRDGCTNNNTNSSETFRPGGGNIKDNWRSELYKYKVVQIEPLGIAPTRCKRRVVGRRRRRRAVGIGAMIFGFLGAAGSTMGAASLTLTVQARQLLSGIVQQQSNLLRAPEAQQHLLQLTVWGIKQLQARVLAVERYLKDQKLLGLWGCSGKIICCTAVPWNSTWSNKSYKEIWDNMTWTQWEREISNYTNQIYDILTESQNQQDRNEKDLLELDKGGGLVPRGGGGSAWSHPQFEK

SEQ ID NO: 425 - protein, 653 aa, Artificial Sequence
  Recombinant HIV protein
ADNLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGCANNTSNETFRPGGGNIKDNWRSELYKYKVVQIEPLGIAPTRCKRRVVGRRRRRRAVGIGAMIFGFLGAAGSTMGAASITLTVQARQLVSGIVQQQSNLLRAPEAQQHLLQLTVWGIKQLQARVLAVERYLKDQKFLGLWGCSGKIICCTAVPWNSTWSNRSFEEIWSNMTWIEWEREISNYTNQIYEILTESQNQQDRNEKDLLELDKGGGLVPRGGGGSAWSHPQFEK

SEQ ID NO: 426 - protein, 652 aa, Artificial Sequence
  Recombinant HIV protein
AEQLWVTVYYGVPVWREANTTLFCASDAKAYDTEVHNVWATHACVPTDPNPQEVVMGNVTEDFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTSVITQACPKVSFEPIPIHYCAPAGFAILKCNNKTFNGKGPCRNVSTVQCTHGIKPVVSTQLLLNGSLAEEDIIIRSENFTNNGKNIIVQLKEPVKINCTRPGNNTRRSINIGPGRAFYATGAIIGDIRKAHCNISTEQWNNTLTQIVDKLREQFGNKTIIFNQSSGGDPEVVMHTFNCGGEFFYCNSTQLFNSTWFNNGTSTWNSTADNITLPCRIKQVINMWQEVGKAMYAPPIRGQIDCSSNITGLILTRDGCSNSSQNETFRPGGGNMKDNWRSELYKYKVVKIEPLGIAPTRCKRRVVGRRRRRRAVTLGAVFLGFLGAAGSTMGAASLTLTVQARLLLSGIVQQQSNLLRAPEAQQHMLQLTVWGIKQLQARVLAIERYLKDQQLLGIWGCSGKLICCTTVPWNTSWSNKSYDYIWNNMTWMQWEREIDNYTGFIYTLIEESQNQQEKNELELLELDKGGGLVPRGGGGSAWSHPQFEK

SEQ ID NO: 427 - protein, 666 aa, Artificial Sequence
  Recombinant HIV protein
AEANLWVTVYYGVPVWKEATTILFCASDAKAYDTEAHNVWATHACVPTDPNPQEIFLVNVTENFNMWKNEMVNQMHEDVISLWDQSLKPCVKLTPLCVTLKCKNVNSTGKNVTSTSNGTYNSTYREEMKNCSFNATTALRDRKQTVYALFYRLDIVPLDEKSSSENSRGYYRLINCNTSAITQACPKVTFDPIPIHYCSPAGYALLKCNDKMFNGTGPCSNVSTVQCTHGIKPVVSTQLLLNGSLAEEEIIIRSENLTNNVKTIIVHLNQSVEIICTRPGNNTRKSIRIGPGQTFYATGDIIGDIRQAHCNISRDKWNETLQRVSKKLAEHFPNKTIKFASSSGGDLEITTHSFNCRGEFFYCNTSGLFNGTYMHNGTQSNSSNSSSIITIPCRIKQIINMWQEVGRAMYAPPIAGNITCKSNITGLLLVRDGCETNQTNFTETFRPGGGDMRDNWRSELYKYKVVEIKPLGVAPTKCKRRVVGRRRRRRAVGGIGAVFLGFLGVAGSTMGAASITLTVQVRQLLSGIVQQQSNLLRAPEAQQHLLQLTVWGIKQLQTRVLAIERYLKDQQLLGIWGCSGKLICCTAVPWNSSWSNKSLTDIWENMTWMQWDKEISNYTNIIYRLLEDSQNQQEENEKDLLALDKGGGLVPRGGGGSAWSHPQFEK

SEQ ID NO: 428 - protein, 650 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNISEGKEEIKNCSFNITTELRDKRKKVYSLFYRLDVVQIDEGDKNSTQYRLINCNTSAITQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGNIRQAHCNVSRSEWNKTLQQVAKQLGKYFGNKKVIFNSSSGGDLEITTHSFNCGGEFFYCNTSGLFNSTWTWDNSTWNQVNSTESNDTIILQCRIKQIINMWQRTGQAIYAPPIQGEIRCVSNITGLLLTRDGCNNNGTSETFRPEGGNMRDNWRSELYKYKVVEIEPLGVAPTRCKRRVVGRRRRRRAVGIGAVFLGFLGAAGSTMGATSITLTVQARQLLSGIVQQQNNLLRAPEAQQHLLKLTVWGIKQLQARVLAVERYLRDQQLLGIWGCSGKLICCTNVPWNSSWSNKSLDEIWNNMTWLQWDKEINNYTQLIYRLIEESQNQQEKNEKELLELDGGGLVPRGGGGSAWSHPQFEK

SEQ ID NO: 429 - protein, 647 aa, Artificial Sequence
  Recombinant HIV protein
ADNLWVTVYYGVPVWKEAETTLFCASDAKAYETEKHNVWATHACVPTDPNPQEIHLENVTEEFNMWKNNMVEQMHTDIISLWDQSLKPCVKLTPLCVTLDCNNVTNNGTSDMREEIKNCSFNMTTELRDKRQKVYSLFYKLDIVQINEDQGNSSNNKYRLITCNTSAITQACPKVTFEPIPIHYCAPAGFAILKCKDEEFNGIGPCKNVSTVQCTHGIKPVVSTQLLLNGSLAEKEVKIRCENITNNAKTIIVQLVNPVKINCTRPNNNTRKSIHIGPGQAFYATGDIIGDIRQAHCNVNRTEWNNTLHQVVEQLRKHFNKTINFANSTGGDLEITTHSFNCGGEFFYCNTTNLFNSTWNHTASMNSTESNDTIILPCRIKQIINMWQRVGQAMYAPPIRGVIRCESNITGLILTRDGCNTNSTRETFRPGGGDMRDNWRSELYKYKVVKIEPLGVAPTKCKRRVVGRRRRRRAVGIGAVFIGFLGAAGSTMGAASITLTVQARQLLSGIVQQQSNLLRAPEAQQHLLKLTVWGIKQLQARVLAVERYLKDQQLLGIWGCSGKLICCTSVPWNSSWSNKSQNEIWDNMTWLQWDKEISNYTQIIYDLLEESQNQQEKNEQDLLALDGGGLVPRGGGGSAWSHPQFEK

SEQ ID NO: 430 - protein, 661 aa, Artificial Sequence
  Recombinant HIV protein
AEQTWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVITQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKAMYAPPISGQIRCSSNITGLLLTRDGCRGNQTDNQTEIFRPVGGDMKNNWRSELYKYKVVRIEPLGIAPTRCKRRVVGRRRRRRAVGIGALFLGFLGAAGSTMGAASMTLTVQARLLLSGIVQQQNNLLRAPEAQQHLLQLTVWGIKQLQARVLAVERYLRDQQLLGIWGCSGKLICCTAVPWNVSWNNRSVDDIWENMTWMQWDREISNYTSLIYTLIEESQNQQEKNEQELLALDGGGLVPRGGGGSAWSHPQFEK

SEQ ID NO: 431 - protein, 645 aa, Artificial Sequence
  Recombinant HIV protein
ADQLWVTVYYGVPVWKDATTTLFCASDAKAYDKEVHNVWATHACVPTDPNPQEVVLGNVTENFNMGKNNMVEQMHEDIISLWDQSLKPCVKLTPLCVTLNCTELKNSTDTNLGTQEIKNCSFNITTSVRNKMKREYALFYSLDIVPIDNDNTSYRLRSCNTSIITQACPKVSFEPIPIHFCAPAGFAILKCNNKTFNGTGPCTNVSTVQCTHGIRPVVSTQLLLNGSLAEEEVVIRSENFTNNAKTIIVQLNESVEINCTRPNNNTRKSIHIGPGRAFYTTGDIIGDIRQAHCNISRTNWTNTLKRVAEKLREKFNNTTIVFNQSSGGDPEIVMHSFNCGGEFFYCNTTQLFNSTWNETNSEGNITSGTITLPCRIKQIINMWQEVGKAMYAPPIGGQIKCLSNITGLLLTRDGCSDNSSSGKEIFRPGGGDMRDNWRSELYKYKVVKIEPLGIAPTKCKRRVVGRRRRRRAVGIGAMFLGFLGAAGSTMGAASLTLTVQARQLLSGIVQQQNNLLRAPEAQQHLLQLTVWGIKQLQARVLALERYLQDQRFLGMWGCSGKLICCTAVPWNASWSNKNLSQIWDNMTWMEWEREISNYTEIIYSLIEESQNQQEKNELDLLQLDGGGLVPRGGGGSAWSHPQFEK

SEQ ID NO: 432 - protein, 651 aa, Artificial Sequence
  Recombinant HIV protein
AGNLWVTVYYGVPVWKEATTTLFCASDAKAYDKEVHNVWATHACVPTDPNPQEMVLGNVTENFNMWKNEMVNQMHEDVISLWDQSLKPCVKLTPLCVTLECSNVTYNESMKEVKNCSFNLTTELRDKKQKVHALFYRLDIVPLNDTEKKNSSRPYRLINCNTSAITQACPKVTFDPIPIHYCTPAGYAILKCNDKKFNGTGPCHKVSTVQCTHGIKPVVSTQLLLNGSLAEGEIIIRSENLTNNAKTIIVHLNQSVEIVCARPSNNTRTSIRIGPGQTFYATGAITGDIRQAHCNISKDKWNETLQRVGEKLAEHFPNKTIKFNSSSGGDLEITTHSFNCRGEFFYCNTSGLFNGTFNGTYVSPNSTDSNSSSIITIPCRIKQIINMWQEVGRAMYAPPIAGNITCKSNITGLLLVRDGCTGSESNKTEIFRPGGGDMRDNWRSELYKYKVVEIKPLGVAPTKCKRRVVGRRRRRRAVGIGAVFLGFLGAAGSTMGAASITLTVQARQLLSGIVQQQSNLLRAPEAQQHLLQLTVWGIKQLQTRVLAIERYLKDQQLLGIWGCSGKLICCTAVPWNYSWSNRSQDDIWDNMTWMQWDKEISNYTNTIYKLLEDSQIQQEKNEKDLLALDSGGGLVPRGGGGSAWSHPQFEK

SEQ ID NO: 433 - protein, 651 aa, Artificial Sequence
  Recombinant HIV protein
AGNLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGCTGLNSSTETFRPGGGDMRDNWRSELYKYKVVEIKPLGVAPTACKRRVVGRRRRRRAVGLGAVFLGFLGAAGSTMGAASITLTVQARQLLSGIVQQQSNLLRAPEAQQHMLQLTVWGIKQLQTRVLAIERYLKDQQLLGIWGCSGKLICCTAVPWNTSWSNRSQADIWGNMTWMQWDREISNYTNTIFRLLEDSQIQQESNEKDLLALDGGGLVPRGGGGSAWSHPQFEK

SEQ ID NO: 434 - protein, 636 aa, Artificial Sequence
  Recombinant HIV protein
AGNLWVTVYYGVPVWKEAKTTLFCASDAKAYEREVHNVWATHACVPTDPNPQEMVLENVTENFNMWKNDMVDQMHEDIISLWDQSLKPCVKLTPLCVTLNCTNASVNATYNGEMKNCSFNATTAIRDKKQQVRALFYSLDIVPLEGNNSSYRLISCNTSAITQACPKVSFDPIPIHYCTPAGYAILKCNDEKFNGTGPCHNVSTVQCTHGIKPVVSTQLLLNGSLAEKEIIIRSENLTNNAKTIIVHLNKAVEIVCVRPNNNTRKSIRIGPGQTFYANDIIGDIRQAHCNISESKWNDTLRQVGAKLAEHFNNNTIRFEPSSGGDLEITTHSFNCRGEFFYCNTSGLFNGTYNHTDTGGNSTNITLPCRIKQIINMWQEVGRAIYAPPVEGNIICISNITGLLLLRDGCHNSTNETFRPGGGDMRDNWRSELYKYKVVEIKPLGVAPTECKRRVVGRRRRRRAVGIGAMFLGFLGAAGSTMGAASITLTVQARQLLSGIVQQQSNLLRAPEAQQHMLQLTVWGIKQLQARVLSIERYLKDQQLLGLWGCSGKLICCTSVPWNHSWSNKSQKDIWENMTWMQWDREINNYTNTIYSLLEESQSQQEKNEKDLLALDGGGLVPRGGGGSAWSHPQFEK

SEQ ID NO: 435 - protein, 657 aa, Artificial Sequence
  Recombinant HIV protein
AGDLWVTVYYGVPVWEDADTTLFCASDAKAYSTESHNVWATHACVPTDPNPQEIPLKNVTENFNMWKNNMVEQMHEDIISLWDESLKPCVKLTPLCVTLICTNVTSNSTNSTNGVTNNSTVDYREQLKNCSFNITTEIRDKQRKEYALFYRLDIVPINDNEKNDTYRLINCNVSTIKQACPKVTFDPIPIHYCAPAGFAILKCRDKKFNGTGPCKNVSTVQCTHGIKPVISTQLLLNGSLAEGDIMIRSENITDNAKTIIVQLKTAVNITCTRPSNNTRKSIRFGPGQAFYATDEIIGDIRQAHCNISKTEWEDMKRNVSDKLKALFNNKTIIFKSSSGGDLEITTHSFNCRGEFFYCNTSGLFNTSGLFNNNSNDSSGNITLPCKIKQIVRMWQRVGQAMYAPPIAGNITCRSRITGLLLVRDGCKSNETNGTETFRPAGGDMRDNWRSELYKYKVVKIKPLGVAPTRCRRRVVGRRRRRRAVGMGAVLLGFLGAAGSTMGAASITLTVQVRQLLSGIVQQQSNLLRAPEAQQHLLQLTVWGIKQLQARVLAVERYLQDQQLLGIWGCSGRLICCTNVPWNASWSNKSYSEIWDNLTWVEWEREISNYTQHIYNLLQESQNQQEKNEQDLLALDKGGGLVPRGGGGSAWSHPQFEK

SEQ ID NO: 436 - protein, 651 aa, Artificial Sequence
  Recombinant HIV protein
ANGLWVTVYYGVPVWREAKTTLFCASDAKSYEKEVHNVWATHACVPTDPNPQELVLKNVTENFNMWKNDMVDQMHEDIISLWDQSLKPCVKLTPLCVTLNCSDAKVNINATYNGTREEIKNCSFNATTELRDKKKKEYALFYRLDIVPLNKEGNNNSEYRLINCNTSVITQACPKVTFDPIPIHYCAPAGYAILKCNNKTFNGTGPCNNVSTVQCTHGIKPVVSTQLLLNGSLAEEEIIIRSENLTDNVKTIIVHLNESVEINCTRPNNNTRKSIRIGPGQTFYATGDIIGDIRQAHCNISEIKWEKTLQRVSEKLREHFNKTIIFNQSSGGDLEITTHSFNCGGEFFYCNTSDLFFNKTFDETYSTGSNSTNSTITLPCRIKQIINMWQEVGRAMYASPIAGEITCKSNITGLLLTRDGCGNNSTEETFRPGGGNMRDNWRSELYKYKVVEVKPLGIAPTECRRRVVGRRRRRRAVVGLGAVFLGFLGTAGSTMGAASITLTVQARQLLSGIVQQQSNLLRAPEAQQHMLQLTVWGIKQLQARVLAIERYLKDQQLLGMWGCSGKLICCTNVYWNSSWSNKTYNEIWDNMTWMQWDREIDNYTDTIYKLLEVSQKQQESNEKDLLALDSGGGLVPRGGGGSAWSHPQFEK

SEQ ID NO: 437 - protein, 651 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLECRNITGVNISEGKEEIKNCSFNITTELRDKRKKVYSLFYRLDVVQIDEGDKNSTQYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGCSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKGGGLEVLFQGPSAWSHPQFEK

SEQ ID NO: 438 - protein, 653 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGCSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKGGGLEVLFQGPSAWSHPQFEK

SEQ ID NO: 439 - protein, 672 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLKCKDVSINNGNVSSSNGSTSHNNSSIDNETLNEGMKEMKNCSFNATTVLRDKKQKVHALFYRLDIVPLNESNKNSRKYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGCSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKGGGLEVLFQGPSAWSHPQFEK

SEQ ID NO: 440 - protein, 648 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGCSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKGGGLEVLFQGPSAWSHPQFEK

SEQ ID NO: 441 - protein, 649 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLHCTNVTSVNTTGDREGLKNCSFNMTTELRDKRQKVYSLFYRLDIVPINENQGSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGCSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKGGGLEVLFQGPSAWSHPQFEK

SEQ ID NO: 442 - protein, 665 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLHCTNANLTKANLTNVNNRTNVSNIIGNITDEVRNCSFNMTTELRDKKQKVHALFYKLDIVPIEDNNDNSKYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGCSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKGGGLEVLFQGPSAWSHPQFEK

SEQ ID NO: 443 - protein, 656 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLHCTNVTISSTNGSTANVTMREEMKNCSFNTTTVIRDKIQKEYALFYKLDIVPIEGKNTNTGYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGCSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKGGGLEVLFQGPSAWSHPQFEK

SEQ ID NO: 444 - protein, 654 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCSDAKVNINATYNGTREEIKNCSFNATTELRDKKKKEYALFYRLDIVPLNKEGNNNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGCSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKGGGLEVLFQGPSAWSHPQFEK

SEQ ID NO: 445 - protein, 227 aa, Artificial Sequence
  Modified antibody sequence
AQVQLVQSGGQMKKPGESMRISCRASGYEFIDCTLNWIRLAPGKRPEWMGWLKPRGGAVNYCRPLQGRVTMTRDVYSDTAFLELRSLTVDDTAVYFCTRGKNCDYNWDFEHWGRGTPVIVSSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDK

SEQ ID NO: 446 - protein, 227 aa, Artificial Sequence
  Modified antibody sequence
AQVQLVQSGGQMKKPGESMRISCRASGYEFIDCTLNWIRLAPGKRPEWMGWLKPRGGAVNYACPLQGRVTMTRDVYSDTAFLELRSLTVDDTAVYFCTRGKNCDYNWDFEHWGRGTPVIVSSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDK

SEQ ID NO: 447 - protein, 211 aa, Artificial Sequence
  Modified antibody sequence
AEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNRGEC

SEQ ID NO: 448 - protein, 227 aa, Artificial Sequence
  Modified antibody sequence
AQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSPSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDK

SEQ ID NO: 449 - protein, 255 aa, Artificial Sequence
  Modified antibody sequence
AEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVGGLVPRGSHHSAWSHPQFEK

SEQ ID NO: 450 - protein, 245 aa, Artificial Sequence
  Modified antibody sequence
AEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVGGGGSGGGGSGGGGSQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVGGLVPRGSHH

SEQ ID NO: 451 - protein, 245 aa, Artificial Sequence
  Modified antibody sequence
AEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVGGGGSGGGGSGGGGSQVQLVQSGGQMKKPGESMRISCRASGYEFIDCTLNWIRLAPGKRPEWMGWLKPRGGAVNYCRPLQGRVTMTRDVYSDTAFLELRSLTVDDTAVYFCTRGKNCDYNWDFEHWGRGTPVIVGGLVPRGSHH

SEQ ID NO: 452 - protein, 230 aa, Artificial Sequence
  Modified antibody sequence
QVQLVQSGAEVKKPGSSVKVSCKASGYEFIDCTLNWVRQAPRQRPEWMGWLKPRGGAVNYARPLQGRVTMTRDVYTSTAYMELRSLRSEDTAVYYCARGKNCDYNWDFEHWGPGTPITISSASTKGPSVFPLAPSSRSTSESTAALGCLVKDYFPEPVTVSWNSGSLTSGVHTFPAVLQSSGLYSLSSVVTVPSSSLGTQTYVCNVNHKPSNTKVDKRVEIKTCGLVPRG

SEQ ID NO: 453 - protein, 230 aa, Artificial Sequence
  Modified antibody sequence
QVQLVQSGAEVKKPGSSVKVSCKASGYEFIDCTLNWVRQAPRQRPEWMGWLKPRGGAVNYACPLQGRVTMTRDVYTSTAYMELRSLRSEDTAVYYCARGKNCDYNWDFEHWGPGTPITISSASTKGPSVFPLAPSSRSTSESTAALGCLVKDYFPEPVTVSWNSGSLTSGVHTFPAVLQSSGLYSLSSVVTVPSSSLGTQTYVCNVNHKPSNTKVDKRVEIKTCGLVPRG

SEQ ID NO: 454 - protein, 240 aa, Artificial Sequence
  Modified antibody sequence
QVQLVQSGAEVKKPGSSVKVSCKASGYEFIDCTLNWVRQAPRQRPEWMGWLKPRGGAVNYACPLQGRVTMTRDVYTSTAYMELRSLRSEDTAVYYCARGKNCDYNWDFEHWGPGTPITISSASTKGPSVFPLAPSSRSTSESTAALGCLVKDYFPEPVTVSWNSGSLTSGVHTFPAVLQSSGLYSLSSVVTVPSSSLGTQTYVCNVNHKPSNTKVDKRVEIKTCGLVPRGSAWSHPQFEK

SEQ ID NO: 455 - protein, 205 aa, Artificial Sequence
  Modified antibody sequence
QSPATLSLSPGERATLSCRTSQYGSLAWYQQKPGQAPRLVIYSGSTRAAGIPDRFSGSRSGPEYTLTISSLESGDFAVYYCQQYEFFGQGTKVQVEIKRAVAAPSVFIFPPSEDQVKSGTVSVVCLLNNFYPREASVKWKVDGVLKTGNSQESVTEQDSKDNTYSLSSTLTLSSTDYQSHNVYACEVTHQGLSSPVTKSFNRGEC

SEQ ID NO: 456 - protein, 230 aa, Artificial Sequence
  Modified antibody sequence
QVQLVQSGAEVKKPGSSVKVSCKASGYEFIDCTLNWVRQAPRQRPEWMGWLKPRGGAVNYCRPLQGRVTMTRDVYTSTAYMELRSLRSEDTAVYYCARGKNCDYNWDFEHWGPGTPITISSASTKGPSVFPLAPSSRSTSESTAALGCLVKDYFPEPVTVSWNSGSLTSGVHTFPAVLQSSGLYSLSSVVTVPSSSLGTQTYVCNVNHKPSNTKVDKRVEIKTCGLVPRG

SEQ ID NO: 457 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDICGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 458 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIICDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 459 - protein, 293 aa, Artificial Sequence
  Modified antibody sequence
MYSMQLASCVTLTLVLLVNSQQVHLQESGPGLVKPSETLSLTCNVSGTLVRDNYWSWIRQPLGKQPEWIGYVHDSGDTNYNPSLKSRVHLSLDKSKNLVSLRLTGVTAADSAIYYCATTKHGRRIYGVVAFKEWFTYFYMDVWGKGTSVTVSSGGGGSGGGGSGGGGTFVSVAPGQTARITCGEESLGSRSVIWYQQRPGQAPSLIIYNNNDRPSGIPDRFSGSPGSTFGTTATLTITSVEAGDEADYYCHIWDSRRPTNWVFGEGTTLIVLSLEVLFQGPGSSAWSHPQFEK

SEQ ID NO: 460 - protein, 293 aa, Artificial Sequence; identical to SEQ ID NO: 459
  Modified antibody sequence

SEQ ID NO: 461 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 462 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 463 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 464 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCNRTVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 465 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNENDTLALD

SEQ ID NO: 466 - protein, 634 aa, Artificial Sequence
  Recombinant HIV protein
AENLTVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 467 - protein, 634 aa, Artificial Sequence
  Recombinant HIV protein
AENLNVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 468 - protein, 634 aa, Artificial Sequence
  Recombinant HIV protein
AENLNVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 469 - protein, 634 aa, Artificial Sequence
  Recombinant HIV protein
AENLTVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 470 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCNRTVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 471 - protein, 802 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 472 - protein, 793 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 473 - protein, 798 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 474 - protein, 800 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 475 - protein, 812 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 476 - protein, 791 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 477 - protein, 803 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 478 - protein, 917 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSLGSDADSAGSLIQPMQIPGIIMPGLRRLTIRDLLAQGRTSSNALEYVREEVFTNNADVVAEKALKPESDITFSKQTANVKTIAHWVQASRQVMDDAPMLQSYINNRLMYGLALKEEGQLLNGDGTGDNLEGLNKVATAYDTSLNATGDTRADIIAHAIYQVTESEFSASGIVLNPRDWHNIALLKDNEGRYIFGGPQAFTSNIMWGLPVVPTKAQAAGTFTVGGFDMASQVWDRMDATVEVSREDRDNFVKNMLTILCEERLALAHYRPTAIIKGTFSSGS

SEQ ID NO: 479 - protein, 919 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSGSLGSDADSAGSLIQPMQIPGIIMPGLRRLTIRDLLAQGRTSSNALEYVREEVFTNNADVVAEKALKPESDITFSKQTANVKTIAHWVQASRQVMDDAPMLQSYINNRLMYGLALKEEGQLLNGDGTGDNLEGLNKVATAYDTSLNATGDTRADIIAHAIYQVTESEFSASGIVLNPRDWHNIALLKDNEGRYIFGGPQAFTSNIMWGLPVVPTKAQAAGTFTVGGFDMASQVWDRMDATVEVSREDRDNFVKNMLTILCEERLALAHYRPTAIIKGTFSSGS

SEQ ID NO: 480 - protein, 921 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSLGSDADSAGSLIQPMQIPGIIMPGLRRLTIRDLLAQGRTSSNALEYVREEVFTNNADVVAEKALKPESDITFSKQTANVKTIAHWVQASRQVMDDAPMLQSYINNRLMYGLALKEEGQLLNGDGTGDNLEGLNKVATAYDTSLNATGDTRADIIAHAIYQVTESEFSASGIVLNPRDWHNIALLKDNEGRYIFGGPQAFTSNIMWGLPVVPTKAQAAGTFTVGGFDMASQVWDRMDATVEVSREDRDNFVKNMLTILCEERLALAHYRPTAIIKGTFSSGS

SEQ ID NO: 481 - protein, 931 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGSLGSDADSAGSLIQPMQIPGIIMPGLRRLTIRDLLAQGRTSSNALEYVREEVFTNNADVVAEKALKPESDITFSKQTANVKTIAHWVQASRQVMDDAPMLQSYINNRLMYGLALKEEGQLLNGDGTGDNLEGLNKVATAYDTSLNATGDTRADIIAHAIYQVTESEFSASGIVLNPRDWHNIALLKDNEGRYIFGGPQAFTSNIMWGLPVVPTKAQAAGTFTVGGFDMASQVWDRMDATVEVSREDRDNFVKNMLTILCEERLALAHYRPTAIIKGTFSSGS

SEQ ID NO: 482 - protein, 773 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGAKLETVTLGNIGKDGKQTLVLNPRGVNPTNGVASLSQAGAVPALEKRVTVSVSQPSRNRKNYKVQVKIQNPTACTANGSCDPSVTRQAYADVTFSFTQYSTDEERAFVRTELAALLASPLLIDAIDQLNPAY

SEQ ID NO: 483 - protein, 781 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGAKLETVTLGNIGKDGKQTLVLNPRGVNPTNGVASLSQAGAVPALEKRVTVSVSQPSRNRKNYKVQVKIQNPTACTANGSCDPSVTRQAYADVTFSFTQYSTDEERAFVRTELAALLASPLLIDAIDQLNPAY

SEQ ID NO: 484 - protein, 771 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGR

SEQ ID NO: 485 - protein, 776 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGSKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGR

SEQ ID NO: 486 - protein, 775 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGAQLQNLVLKDREATPNDHTFVPRDIRDNVGEVVESTGVPIGESRFTISLRKTSNGRYKSTLKLVVPVVQSQTVNGIVTPVVVRTSYVTVDFDYDARSTTKERNNFVGMIADALKADKMLVHDTIVNLQGVY

SEQ ID NO: 487 - protein, 780 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGAQLQNLVLKDREATPNDHTFVPRDIRDNVGEVVESTGVPIGESRFTISLRKTSNGRYKSTLKLVVPVVQSQTVNGIVTPVVVRTSYVTVDFDYDARSTTKERNNFVGMIADALKADKMLVHDTIVNLQGVY

SEQ ID NO: 488 - protein, 773 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGATLRSFVLVDNGGTGNVTVVPVSNANGVAEWLSNNSRSQAYRVTASYRASGADKRKYTIKLEVPKIVTQVVNGVELPVSAWKAYASIDLTIPIFAATDDVTVISKSLAGLFKVGNPIAEAISSQSGFYA

SEQ ID NO: 489 - protein, 778 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGATLRSFVLVDNGGTGNVTVVPVSNANGVAEWLSNNSRSQAYRVTASYRASGADKRKYTIKLEVPKIVTQVVNGVELPVSAWKAYASIDLTIPIFAATDDVTVISKSLAGLFKVGNPIAEAISSQSGFYA

SEQ ID NO: 490 - protein, 766 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGALGDTLTITLGGSGGTAKVLRKINQDGYTSEYYLPETSSSFRAKVRHTKESVKPNQVQYERHNVEFTETVYASGSTPEFVRQAYVVIRHKVGDVSATVSDLGEALSFYLNEALYGKLIGWES

SEQ ID NO: 491 - protein, 771 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGALGDTLTITLGGSGGTAKVLRKINQDGYTSEYYLPETSSSFRAKVRHTKESVKPNQVQYERHNVEFTETVYASGSTPEFVRQAYVVIRHKVGDVSATVSDLGEALSFYLNEALYGKLIGWES

SEQ ID NO: 492 - protein, 773 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGASNFEEFVLVDNGGTGDVKVAPSNFANGVAEWISSNSRSQAYKVTCSVRQSSANNRKYTVKVEVPKVATQVQGGVELPVAAWRSYMNMELTIPVFATNDDCALIVKALQGTFKTGNPIATAIAANSGIY

SEQ ID NO: 493 - protein, 778 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGASNFEEFVLVDNGGTGDVKVAPSNFANGVAEWISSNSRSQAYKVTCSVRQSSANNRKYTVKVEVPKVATQVQGGVELPVAAWRSYMNMELTIPVFATNDDCALIVKALQGTFKTGNPIATAIAANSGIY

SEQ ID NO: 494 - protein, 770 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGASNFTQFVLVDNGGTGDVTVAPSNFANGVAEWISSNSRSQAYKVACSVRQSSAQNRKYTIKVEVPKVATQTVGGVELPVAAWRSYLNMELTIPIFATNSDCELIVKAMQGLLKDGNPIPSAIAANSGIY

SEQ ID NO: 495 - protein, 778 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGASNFTQFVLVDNGGTGDVTVAPSNFANGVAEWISSNSRSQAYKVACSVRQSSAQNRKYTIKVEVPKVATQTVGGVELPVAAWRSYLNMELTIPIFATNSDCELIVKAMQGLLKDGNPIPSAIAANSGIY

SEQ ID NO: 496 - protein, 1028 aa, Artificial Sequence
  Recombinant HIV protein
AMTTRNNNNVLAVSKKQLGVLAASAAVGALRNYIGESSPALLQSAVGLGKKALNKVRNRRKQGNQQIITHVGGVGGSIMAPVAVSRQLVGSKPKFTGRTSGGVTVTSHREYLTQVNNSSGFVVNGGIVGNSLQLNPSNGTLFSWLPALASNFDQYSFNSVVLDYVPLCGTTEVGRVALYFDKDSQDPEPADRVELANFGVLKETAPWAEAMLRIPTDKVKRYCNDSATVDQKLIDLGQLGIATYGGAGADAVGELFLARSVTLYFPQPTNTLLSSKRLDLTGSLADATGPGYLVLTRTPTVLTHTFRATGTFNLSGGLRCLTSLTLGATGAVVINDILAIDNVGTASDYFLNCTVSSLPATVTFTVSGVAAGILLVGRARANVVNLLGSGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 497 - protein, 1036 aa, Artificial Sequence
  Recombinant HIV protein
AMTTRNNNNVLAVSKKQLGVLAASAAVGALRNYIGESSPALLQSAVGLGKKALNKVRNRRKQGNQQIITHVGGVGGSIMAPVAVSRQLVGSKPKFTGRTSGGVTVTSHREYLTQVNNSSGFVVNGGIVGNSLQLNPSNGTLFSWLPALASNFDQYSFNSVVLDYVPLCGTTEVGRVALYFDKDSQDPEPADRVELANFGVLKETAPWAEAMLRIPTDKVKRYCNDSATVDQKLIDLGQLGIATYGGAGADAVGELFLARSVTLYFPQPTNTLLSSKRLDLTGSLADATGPGYLVLTRTPTVLTHTFRATGTFNLSGGLRCLTSLTLGATGAVVINDILAIDNVGTASDYFLNCTVSSLPATVTFTVSGVAAGILLVGRARANVVNLLGGSGGGGSGGGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 498 - protein, 907 aa, Artificial Sequence
  Recombinant HIV protein
AKRLSIQQLAKAIANTLETPPQPKAGRRRNRRRQRSAVQQLPPIQAGISMAPSAQGAMVRIRNPAVSSSRGAITVLHCELTAEIGVTDSIVVSSELVMPYTVGTWLRGVADNWSKYSWLSVRYTYIPSCPSSTAGSIHMGFQYDMADTVPVSVNKLSNLRGYVSGQVWSGSAGLCFINNSRCSDTSTAISTTLDVSELGKKWYPYKTSADYATAVGVDVNIATDLVPARLVIALLDGSSSTAVAAGRIYDTYTIQMIEPTASALNLGSGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 499 - protein, 915 aa, Artificial Sequence
  Recombinant HIV protein
AKRLSIQQLAKAIANTLETPPQPKAGRRRNRRRQRSAVQQLPPIQAGISMAPSAQGAMVRIRNPAVSSSRGAITVLHCELTAEIGVTDSIVVSSELVMPYTVGTWLRGVADNWSKYSWLSVRYTYIPSCPSSTAGSIHMGFQYDMADTVPVSVNKLSNLRGYVSGQVWSGSAGLCFINNSRCSDTSTAISTTLDVSELGKKWYPYKTSADYATAVGVDVNIATDLVPARLVIALLDGSSSTAVAAGRIYDTYTIQMIEPTASALNLGGSGGGGSGGGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 500 - protein, 879 aa, Artificial Sequence
  Recombinant HIV protein
ARKGKKTNSNQGQQGKRKSRRPRGRSAEPQLQRAPVAQASRISGTVPGPLSSNTWPLHSVEFLADFKRSSTSADATTYDCVPFNLPRVWSLARCYSMWKPTRWDVVYLPEVSATVAGSIEMCFLYDYADTIPRYTGKMSRTAGFVTSSVWYGAEGCHLLSGGSARNAVVASMDCSRVGWKRVTSSIPSSVDPNVVNTILPARLAVRSSIKPTVSDTPGKLYVIASMVLRDPVDPTLNTGSGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 501 - protein, 887 aa, Artificial Sequence
  Recombinant HIV protein
ARKGKKTNSNQGQQGKRKSRRPRGRSAEPQLQRAPVAQASRISGTVPGPLSSNTWPLHSVEFLADFKRSSTSADATTYDCVPFNLPRVWSLARCYSMWKPTRWDVVYLPEVSATVAGSIEMCFLYDYADTIPRYTGKMSRTAGFVTSSVWYGAEGCHLLSGGSARNAVVASMDCSRVGWKRVTSSIPSSVDPNVVNTILPARLAVRSSIKPTVSDTPGKLYVIASMVLRDPVDPTLNTGGSGGGGSGGGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 502 - protein, 894 aa, Artificial Sequence
  Recombinant HIV protein
MVRKGAAAKAPQQPKPKAQQQPGGRRRRRGRSMEPVSRPLNPPAAVGSTLKAGRGRTAGVSDWFDTGMITSYLGGFQRTAGTTDSQVFIVSPAALDRVGTIAKAYALWRPKHWEIVYLPRCSTQTDGSIEMGFLLDYADSVPTNTRTMASSTSFTTSNVWGGGDGSSLLHTSMKSMGNAVTSALPCDEFSNKWFKLSWSTPEESENAHLTDTYVPARFVVRSDFPVVTADQPGHLWLRSRILLKGSVSPSTNLGSGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 503 - protein, 902 aa, Artificial Sequence
  Recombinant HIV protein
MVRKGAAAKAPQQPKPKAQQQPGGRRRRRGRSMEPVSRPLNPPAAVGSTLKAGRGRTAGVSDWFDTGMITSYLGGFQRTAGTTDSQVFIVSPAALDRVGTIAKAYALWRPKHWEIVYLPRCSTQTDGSIEMGFLLDYADSVPTNTRTMASSTSFTTSNVWGGGDGSSLLHTSMKSMGNAVTSALPCDEFSNKWFKLSWSTPEESENAHLTDTYVPARFVVRSDFPVVTADQPGHLWLRSRILLKGSVSPSTNLGGSGGGGSGGGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 504 - protein, 897 aa, Artificial Sequence
  Recombinant HIV protein
LMTKHTLEQLAADLRRAAEQGEAIAPLRDLIGIDNAEAAYAIQHINVQHDVAQGRRVVGRKVGLTHPKVQQQLGVDQPDFGTLFADMCYGDNEIIPFSRVLQPRIEAEIALVLNRDLPATDITFDELYNAIEWVLPALEVVGSRIRDWSIQFVDTVADNASCGVYVIGGPAQRPAGLDLKNCAMKMTRNNEEVSSGRGSECLGHPLNAAVWLARKMASLGEPLRTGDIILTGALGPMVAVNAGDRFEAHIEGIGSVAATFSSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 505 - protein, 899 aa, Artificial Sequence
  Recombinant HIV protein
LMTKHTLEQLAADLRRAAEQGEAIAPLRDLIGIDNAEAAYAIQHINVQHDVAQGRRVVGRKVGLTHPKVQQQLGVDQPDFGTLFADMCYGDNEIIPFSRVLQPRIEAEIALVLNRDLPATDITFDELYNAIEWVLPALEVVGSRIRDWSIQFVDTVADNASCGVYVIGGPAQRPAGLDLKNCAMKMTRNNEEVSSGRGSECLGHPLNAAVWLARKMASLGEPLRTGDIILTGALGPMVAVNAGDRFEAHIEGIGSVAATFSSGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 506 - protein, 901 aa, Artificial Sequence
  Recombinant HIV protein
LMTKHTLEQLAADLRRAAEQGEAIAPLRDLIGIDNAEAAYAIQHINVQHDVAQGRRVVGRKVGLTHPKVQQQLGVDQPDFGTLFADMCYGDNEIIPFSRVLQPRIEAEIALVLNRDLPATDITFDELYNAIEWVLPALEVVGSRIRDWSIQFVDTVADNASCGVYVIGGPAQRPAGLDLKNCAMKMTRNNEEVSSGRGSECLGHPLNAAVWLARKMASLGEPLRTGDIILTGALGPMVAVNAGDRFEAHIEGIGSVAATFSSGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 507 - protein, 911 aa, Artificial Sequence
  Recombinant HIV protein
LMTKHTLEQLAADLRRAAEQGEAIAPLRDLIGIDNAEAAYAIQHINVQHDVAQGRRVVGRKVGLTHPKVQQQLGVDQPDFGTLFADMCYGDNEIIPFSRVLQPRIEAEIALVLNRDLPATDITFDELYNAIEWVLPALEVVGSRIRDWSIQFVDTVADNASCGVYVIGGPAQRPAGLDLKNCAMKMTRNNEEVSSGRGSECLGHPLNAAVWLARKMASLGEPLRTGDIILTGALGPMVAVNAGDRFEAHIEGIGSVAATFSSGGSGGGGSGGGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 508 - protein, 670 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGMKQIEDKIEEIESKIKKIENEIARIKKLIGE

SEQ ID NO: 509 - protein, 697 aa, Artificial Sequence
  Recombinant HIV protein
GSSGVRLWATRQAMLGQVHEVPEGWLIFVAEQEELYVRVQNGFRKVQLEARTPLPRGGSGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 510 - protein, 692 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSSGVRLWATRQAMLGQVHEVPEGWLIFVAEQEELYVRVQNGFRKVQLEARTPLPR

SEQ ID NO: 511 - protein, 650 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCSDAKVNINATYNGTREEIKNCSFNATTELRDKKKKEYALFYRLDIVPLNKEGNNNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGLEVLFQGPGHH

SEQ ID NO: 512 - protein, 647 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLECRNITGVNISEGKEEIKNCSFNITTELRDKRKKVYSLFYRLDVVQIDEGDKNSTQYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGLEVLFQGPGHH

SEQ ID NO: 513 - protein, 649 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGLEVLFQGPGHH

SEQ ID NO: 514 - protein, 668 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLKCKDVSINNGNVSSSNGSTSHNNSSIDNETLNEGMKEMKNCSFNATTVLRDKKQKVHALFYRLDIVPLNESNKNSRKYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGLEVLFQGPGHH

SEQ ID NO: 515 - protein, 644 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGLEVLFQGPGHH

SEQ ID NO: 516 - protein, 645 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLHCTNVTSVNTTGDREGLKNCSFNMTTELRDKRQKVYSLFYRLDIVPINENQGSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGLEVLFQGPGHH

SEQ ID NO: 517 - protein, 661 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLHCTNANLTKANLTNVNNRTNVSNIIGNITDEVRNCSFNMTTELRDKKQKVHALFYKLDIVPIEDNNDNSKYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGLEVLFQGPGHH

SEQ ID NO: 518 - protein, 652 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLHCTNVTISSTNGSTANVTMREEMKNCSFNTTTVIRDKIQKEYALFYKLDIVPIEGKNTNTGYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGLEVLFQGPGHH

SEQ ID NO: 519 - protein, 4 aa, Artificial Sequence
  Protein linker
GGSG

SEQ ID NO: 520 - protein, 5 aa, Artificial Sequence
  Protein linker
GSGSG

SEQ ID NO: 521 - protein, 6 aa, Artificial Sequence
  Protein linker
GSGGSG

SEQ ID NO: 522 - protein, 10 aa, Artificial Sequence
  Protein linker
GSGGSGGGSG

SEQ ID NO: 523 - protein, 15 aa, Artificial Sequence
  Protein linker
GSGGGSGGGSGGGSG

SEQ ID NO: 524 - protein, 5 aa, Artificial Sequence
  Protein linker
GGSGG

SEQ ID NO: 525 - protein, 7 aa, Artificial Sequence
  Protein linker
GGSGGSG

SEQ ID NO: 526 - protein, 8 aa, Artificial Sequence
  Protein linker
GGSGGGSG

SEQ ID NO: 527 - protein, 9 aa, Artificial Sequence
  Protein linker
GGSGGSGGG

SEQ ID NO: 528 - protein, 10 aa, Artificial Sequence
  Protein linker
GGSGGGGSGG

SEQ ID NO: 529 - protein, 11 aa, Artificial Sequence
  Protein linker
GGSGGGSGGSG

SEQ ID NO: 530 - protein, 11 aa, Artificial Sequence
  Protein linker
GGGSGGGGSGG

SEQ ID NO: 531 - protein, 12 aa, Artificial Sequence
  Protein linker
GGSGGGSGGGSG

SEQ ID NO: 532 - protein, 13 aa, Artificial Sequence
  Protein linker
GGSGGGGSGGGSG

SEQ ID NO: 533 - protein, 14 aa, Artificial Sequence
  Protein linker
GGSGGGGSGGSGGG

SEQ ID NO: 534 - protein, 15 aa, Artificial Sequence
  Protein linker
GGSGGGGSGGGGSGG

SEQ ID NO: 535 - protein, 20 aa, Artificial Sequence
  Protein linker
GGSGGGGSGGGGSGGGGSGG

SEQ ID NO: 536 - protein, 8 aa, Artificial Sequence
  Protein linker
GGGSGGSG

SEQ ID NO: 537 - protein, 16 aa, Artificial Sequence
  Protein linker
GGGSGGGGSGGGGSGG

SEQ ID NO: 538 - protein, 21 aa, Artificial Sequence
  Protein linker
GGGSGGGGSGGGGSGGGGSGG

SEQ ID NO: 539 - protein, 31 aa, Artificial Sequence
  Protein linker
GGSGGSGGSGGSGGSGGSGGSGGSGGSGGSS

SEQ ID NO: 540 - protein, 37 aa, Artificial Sequence
  Protein linker
GGSGGSGGSGGSGGSGGSGGSGGSGGSGGSGGSGGSS

SEQ ID NO: 541 - protein, 38 aa, Artificial Sequence
  Protein linker
GGSGGSGGSGGSGGSGGSGGSGGSGGSGGSGGSGGSGG

SEQ ID NO: 542 - protein, 24 aa, Artificial Sequence
  Protein linker
GGSGGSGGSGGSGGSGGSGVGIGG

SEQ ID NO: 543 - protein, 663 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 544 - protein, 668 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 545 - protein, 667 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 546 - protein, 672 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 547 - protein, 700 aa, Artificial Sequence
  Recombinant HIV protein
QQIITIGSICMVVGIISLILQIGNIISIWISGGSGGSAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 548 - protein, 709 aa, Artificial Sequence
  Recombinant HIV protein
QQIITIGSICMVVGIISLILQIGNIISIWISGGSGGSGGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 549 - protein, 704 aa, Artificial Sequence
  Recombinant HIV protein
QQIITIGSICMVVGIISLILQIGNIISIWISGGSGGSAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 550 - protein, 713 aa, Artificial Sequence
  Recombinant HIV protein
QQIITIGSICMVVGIISLILQIGNIISIWISGGSGGSGGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 551 - protein, 700 aa, Artificial Sequence
  Recombinant HIV protein
QQIITIGSICMVVGIISLILQIGNIISIWISGGSGGSAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 552 - protein, 709 aa, Artificial Sequence
  Recombinant HIV protein
QQIITIGSICMVVGIISLILQIGNIISIWISGGSGGSGGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 553 - protein, 704 aa, Artificial Sequence
  Recombinant HIV protein
QQIITIGSICMVVGIISLILQIGNIISIWISGGSGGSAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 554 - protein, 713 aa, Artificial Sequence
  Recombinant HIV protein
QQIITIGSICMVVGIISLILQIGNIISIWISGGSGGSGGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 555 - protein, 663 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 556 - protein, 668 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 557 - protein, 667 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 558 - protein, 672 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 559 - protein, 704 aa, Artificial Sequence; identical to SEQ ID NO: 553
  Recombinant HIV protein

SEQ ID NO: 560 - protein, 671 aa, Artificial Sequence
  Recombinant HIV protein
QQIITIGSICMVVGIISLILQIGNIISIWISGGSGGSAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 561 - protein, 675 aa, Artificial Sequence
  Recombinant HIV protein
QQIITIGSICMVVGIISLILQIGNIISIWISGGSGGSGGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 562 - protein, 675 aa, Artificial Sequence
  Recombinant HIV protein
QQIITIGSICMVVGIISLILQIGNIISIWISGGSGGSAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 563 - protein, 679 aa, Artificial Sequence
  Recombinant HIV protein
QQIITIGSICMVVGIISLILQIGNIISIWISGGSGGSGGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 564 - protein, 700 aa, Artificial Sequence
  Recombinant HIV protein
QQIITIGSICMVVGIISLILQIGNIISIWISGGSGGSAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 565 - protein, 709 aa, Artificial Sequence
  Recombinant HIV protein
QQIITIGSICMVVGIISLILQIGNIISIWISGGSGGSGGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 566 - protein, 704 aa, Artificial Sequence
  Recombinant HIV protein
QQIITIGSICMVVGIISLILQIGNIISIWISGGSGGSAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 567 - protein, 713 aa, Artificial Sequence
  Recombinant HIV protein
QQIITIGSICMVVGIISLILQIGNIISIWISGGSGGSGGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 568 - protein, 663 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 569 - protein, 668 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 570 - protein, 667 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDGGSGGSILAIYSTVASSLVLLVSLGAISF

SEQ ID NO: 571 - protein, 672 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQPMYAPPIQGVIRCVSNITGLILTRDGGSTNSTTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 572 - protein, 4 aa, Artificial Sequence
  protease cleavage site
REKR

SEQ ID NO: 573 - protein, 6 aa, Artificial Sequence
  protease cleavage site
RRRRRR

SEQ ID NO: 574 - protein, 9 aa, Artificial Sequence
  protein linker
GGSGGSGGS

SEQ ID NO: 575 - protein, 173 aa, Artificial Sequence
  Ferritin subunit
ESQVRQQFSKDIEKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 576 - protein, 154 aa, Artificial Sequence
  Lumazine synthase subunit
MQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 577 - protein, 265 aa, Artificial Sequence [sequence omitted]

SEQ ID NO: 578 - protein, 26 aa, Artificial Sequence
  Foldon domain
GYIPEAPRDGQAYVRKDGEWVLLSTF

SEQ ID NO: 579 - protein, 628 aa, Artificial Sequence
  Recombinant HIV protein
AENLWVTVYYGVPVWKDAETTLFCASDAKSYEKEVHNVWATHACVPTDPNPQEIHLENVTENFNMWKNNMVEQMHTDIISLWDQSLKPCVKLTPLCVTLNCSDAKVNINATYNGTREEIKNCSFNATTELRDKKKKEYALFYRLDIVPLNKEGNNNSEYRLINCNTSVITQACPKVTFDPIPIHYCAPAGFAILKCNNKTFNGTGPCNNVSTVQCTHGIKPVVSTQLLLNGSLAEEEIIIRSENLTDNVKTIIVHLNESVEINCTRPNNNTRKSIRIGPGQTFYATGDIIGDIRQAHCNISEIKWEKTLQRVSEKLREHFNKTIIFNQSSGGDLEITTHSFNCGGEFFYCNTSDLFFNKTFDETYSTGSNSTNSTITLPCRIKQIINMWQEVGRAMYASPIAGEITCKSNITGLLLTRDGGGNNSTEETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 580 - protein, 624 aa, Artificial Sequence
  Recombinant HIV protein
AENLWVTVYYGVPVWKDAETTLFCASNAKAYEKEVHNIWATHACVPTDPNPQEIHLENVTENFNMWKNNMVEQMHTDIISLWDQSLKPCVKLTSLCVTLKCSNFTGKSNVTYKGDMEVKNCSFNVTTEIRDKKQKVYALFYRLDITPLDDNSSEYILINCNSSTITQACPKVNFDPIPIHYCAPAGFAILKCNNKTFNGTGPCHNVSTVQCTHGIKPVVSTQLLLNGSLAEGEIIIRSENLTDNVKTIIVHFNESVEITCTRPNNNTRKSISIGPGQAIYATGDIIGDIRQAHCNISKENWNKTLQWVRGKLKEHFPNKTIVFKPSSGGDLEITTHSFNCRGEFFYCNTSKLFNSTDNSTHMGTENNTIITIPCRIKQIINMWQEVGRAMYAPPIEGNITCKSNITGLLLVRDGGWDNSTNDTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 581 - protein, 636 aa, Artificial Sequence
  Recombinant HIV protein
AENLWVTVYYGVPVWKDAETTLFCASDAKAYDTEVHNVWATHACVPTDPNPQEIHLENVTENFNMWKNNMIEQMHTDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSAITQACPKVTFDPIPIHYCTPAGFAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNISRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQAMYAPPIAGNITCSSNITGLLLERDGGRDINNTEIFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 582 - protein, 650 aa, Artificial Sequence
  Recombinant HIV protein
AENLWVTVYYGVPVWKDAETTLFCASDAKAYETEVHNVWATHACVPTDPNPQEIHLENVTENFNMWKNNMAEQMHTDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSAITQACPKVTFDPIPIHYCTPAGFAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 583 - protein, 630 aa, Artificial Sequence
  Recombinant HIV protein
AENLWVTVYYGVPVWKDAETTLFCASDAKAYETEVHNVWATHACVPTDPNPQEIHLENVTENFNMWKNNMVEQMHTDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 584 - protein, 622 aa, Artificial Sequence
  Recombinant HIV protein
AENLWVTVYYGVPVWKDAETTLFCASDAKAYDTEVHNVWATHACVPTDPNPQEIHLENVTENFNMWKNNMVEQMHTDIISLWDQSLKPCVKLTPLCVTLNCTDVTVNGTIVKVNSTGMKNCSFNITTEIRDKKKKESALFYRLDIVPLDESSDSSSNYSEYRLISCNTSTITQACPKVTFDPIPIHYCAPAGFAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRAIYAPPIAGNITCTSDITGLLLTRDGGSDGNSTKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 585 - protein, 616 aa, Artificial Sequence
  Recombinant HIV protein
AENLWVTVYYGVPVWKDAETTLFCASDAKAYEREVHNVWATHACVPTDPNPQEIHLENVTENFNMWKNNMVEQMQTDIISLWDQSLKPCVKLTPLCVTLNCSKLNNATDGEMKNCSFNATTELWDKKKQVYALFYKLDIVPLDGRNNSSEYRLINCNTSTITQACPKVSFDPIPIHYCAPAGFAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 586 - protein, 616 aa, Artificial Sequence
  Recombinant HIV protein
AENLWVTVYYGVPVWKDAETTLFCASDAKAYEREVHNVWATHACVPTDPNPQEIHLENVTENFNMWKNNMVEQMQTDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGFAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 587 - protein, 631 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQAMYAPPIQGVIRCQSNITGILLTRDGGNTGNNSRTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 588 - protein, 631 aa, Artificial Sequence
  Recombinant HIV protein
AENLWVTVYYGVPVWKDAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQAMYAPPIQGVIRCQSNITGILLTRDGGNTGNNSRTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 589 - protein, 616 aa, Artificial Sequence
  Recombinant HIV protein
AENLWVTVYYGVPVWREAKTTLFCASDAKAYETEAHSVWATHACVPTDPNPQEMVLENVTENFNMWKNDMVDQMHEDVISIWDQSLKPCVKLTPLCVTLDCSTYNNTHNISKEMKICSFNMTTELRDKKRKVNVLFYKLDLVPLTNSSNTTNYRLISCNTSTITQACPKVSFDPIPIHYCAPAGYAILKCNNKTFNGTGPCNNVSTVQCTHGIKPVVSTQLLLNGSLAEEEIIIRFENLTDNVKIIIVQLNETINITCTRPNNNTRKSIRIGPGQSFYATGEIVGNIREAHCNISASKWNKTLERVRTKLKEHFPNKTIEFEPSSGGDLEITTHSFNCGGEFFYCNTSGLFNSAINGTLTSNVTLPCRIKQIINMWQEVGRAMYAPPIAGNITCKSNITGLLLTRDGGENSSSTTETFRPTGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 590 - protein, 616 aa, Artificial Sequence
  Recombinant HIV protein
AENLWVTVYYGVPVWKDAETTLFCASDAKAYETEAHSVWATHACVPTDPNPQEIHLENVTENFNMWKNNMVEQMHTDVISIWDQSLKPCVKLTPLCVTLDCSTYNNTHNISKEMKICSFNMTTELRDKKRKVNVLFYKLDLVPLTNSSNTTNYRLISCNTSTITQACPKVSFDPIPIHYCAPAGFAILKCNNKTFNGTGPCNNVSTVQCTHGIKPVVSTQLLLNGSLAEEEIIIRFENLTDNVKIIIVQLNETINITCTRPNNNTRKSIRIGPGQSFYATGEIVGNIREAHCNISASKWNKTLERVRTKLKEHFPNKTIEFEPSSGGDLEITTHSFNCGGEFFYCNTSGLFNSAINGTLTSNVTLPCRIKQIINMWQEVGRAMYAPPIAGNITCKSNITGLLLTRDGGENSSSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 591 - protein, 631 aa, Artificial Sequence
  Recombinant HIV protein
AENLWVTVYYGVPVWKDAETTLFCASDAKAYDTEVHNVWATHACVPTDPNPQEIYMENVTEEFNMWKNNMVEQMHTDIISLWDQSLKPCVQLTPLCVTLDCSYNITNNITNSITNSSVNMREEIKNCSFNMTTELRDKNRKVYSLFYKLDVVQINNGNNSSNLYRLINCNTSALTQACPKVTFEPIPIRYCAPAGYAILKCNDKEFNGTGLCKNVSTVQCTHGIRPVVSTQLLLNGSLAEGKVMIRSENITNNVKNIIVQLNETVTINCTRPNNNTRKSVRIGPGQTFYATGDIIGDIRQAHCNVSGSQWNRALHQVVGQLREYWNTTIIFKNSSGGDLEITTHSFNCGGEFFYCNTSGLFNSNWTHNDTASMKPNDTITLPCRIKQIINMWQRVGQAIYAPPIQGVIRCESNITGLILTRDGGGNINESQIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 592 - protein, 631 aa, Artificial Sequence
  Recombinant HIV protein
AENLWVTVYYGVPVWKDAETTLFCASDAKAYDTEVHNVWATHACVPTDPNPQEIYMENVTEEFNMWRNNMVNQMHTDIISLWDQSLKPCVQLTPLCVTLDCSYNITNNITNSITNSSVNMREEIKNCSFNMTTELRDKNRKVYSLFYKLDVVQINNGNNSSNLYRLINCNTSALTQACPKVTFEPIPIRYCAPAGYAILKCNDKEFAGTGLCKNVSTVQCTHGIRPVVSTQLLLNGSLAEGKVMIRSSNIKDNAKNIIVQLNETVTINCTRPNNNTRKSVRIGPGQTFYATGDIIGDIRQAHCNVSGSQWNRALHQVVGQLREYWNTTIIFKNSSGGDLEITTHSFNCGGEFFYCNTSGLFNSNWTHNDTASMKPNDTITLPCRIKQIINMWQRVGQAIYAPPIQGVIRCESNITGLILTRDGGDSTNESQQFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 593 - protein, 635 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLNCTDYLGNATNTTSSSGGAMEGGEIKNCSFNITTSMRDKMQKEYALFYKLDVVSIDNDNASTNYRLISCNTSVITQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLFNSTWTWNDTEVVNNTEKNINITLPCRIKQIINMWQEVGKAMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 594 - protein, 609 aa, Artificial Sequence
  Recombinant HIV protein
AENLWVTVYYGVPVWKEAKATLFCASDAKAQETEVHNIWATHACVPTDPNPQEMILENVTENFNMWKNDMVDQMHEDVISLWDQSLKPCIKLTPLCVTLNCTNATYNGSTIEDVRNCSFNATTEVKNKKQEVNALFNLLDIVPIKSSIYRLTNCNTSAITQACPKVTFDPIPIHYCAPAGYAILKCNNKTFNGKGPCNNVSTVQCTHGIKPVVSTQLLLNGSLAEEDIIIRSENLANNVKTIIVHLKEPVEIVCTRPGNNTRKSVRIGPGQTFYATGAIIGDIRKAHCNISKKAWNDTLHKVEGKLRELYNKSIKFEPSSGGDLEITTHSFNCRGEFFYCNTTKLFHEGSRKNDNDTITLPCRIKQFINMWQEVGRAMYAPPIAGNITCNSSITGILLVRDGGTNNANETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 595 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGNTANNAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 596 - protein, 764 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGR

SEQ ID NO: 597 - protein, 767 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGSGTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGR

SEQ ID NO: 598 - protein, 769 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVATSQVEDLVVNLVPLGR

SEQ ID NO: 599 - protein, 764 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSGVTLGNIGKDGKQTLVLNPRGVNPTNGVASLSQAGAVPALEKRVTVSVSQPSRNRKNYKVQVKIQNPTACTANGSCDPSVTRQAYADVTFSFTQYSTDEERAFVRTELAALLASPLLIDAIDQLNPAY

SEQ ID NO: 600 - protein, 766 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGVTLGNIGKDGKQTLVLNPRGVNPTNGVASLSQAGAVPALEKRVTVSVSQPSRNRKNYKVQVKIQNPTACTANGSCDPSVTRQAYADVTFSFTQYSTDEERAFVRTELAALLASPLLIDAIDQLNPAY

SEQ ID NO: 601 - protein, 771 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGVTLGNIGKDGKQTLVLNPRGVNPTNGVASLSQAGAVPALEKRVTVSVSQPSRNRKNYKVQVKIQNPTACTANGSCDPSVTRQAYADVTFSFTQYSTDEERAFVRTELAALLASPLLIDAIDQLNPAY

SEQ ID NO: 602 - protein, 763 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSGLVLKDREATPNDHTFVPRDIRDNVGEVVESTGVPIGESRFTISLRKTSNGRYKSTLKLVVPVVQSQTVNGIVTPVVVRTSYVTVDFDYDARSTTKERNNFVGMIADALKADKMLVHDTIVNLQGVY

SEQ ID NO: 603 - protein, 765 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGLVLKDREATPNDHTFVPRDIRDNVGEVVESTGVPIGESRFTISLRKTSNGRYKSTLKLVVPVVQSQTVNGIVTPVVVRTSYVTVDFDYDARSTTKERNNFVGMIADALKADKMLVHDTIVNLQGVY

SEQ ID NO: 604 - protein, 770 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGLVLKDREATPNDHTFVPRDIRDNVGEVVESTGVPIGESRFTISLRKTSNGRYKSTLKLVVPVVQSQTVNGIVTPVVVRTSYVTVDFDYDARSTTKERNNFVGMIADALKADKMLVHDTIVNLQGVY

SEQ ID NO: 605 - protein, 761 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSGFVLVDNGGTGNVTVVPVSNANGVAEWLSNNSRSQAYRVTASYRASGADKRKYTIKLEVPKIVTQVVNGVELPVSAWKAYASIDLTIPIFAATDDVTVISKSLAGLFKVGNPIAEAISSQSGFYA

SEQ ID NO: 606 - protein, 763 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGFVLVDNGGTGNVTVVPVSNANGVAEWLSNNSRSQAYRVTASYRASGADKRKYTIKLEVPKIVTQVVNGVELPVSAWKAYASIDLTIPIFAATDDVTVISKSLAGLFKVGNPIAEAISSQSGFYA

SEQ ID NO: 607 - protein, 768 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGFVLVDNGGTGNVTVVPVSNANGVAEWLSNNSRSQAYRVTASYRASGADKRKYTIKLEVPKIVTQVVNGVELPVSAWKAYASIDLTIPIFAATDDVTVISKSLAGLFKVGNPIAEAISSQSGFYA

SEQ ID NO: 608 - protein, 762 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGFVLVDNGGTGDVKVAPSNFANGVAEWISSNSRSQAYKVTCSVRQSSANNRKYTVKVEVPKVATQVQGGVELPVAAWRSYMNMELTIPVFATNDDCALIVKALQGTFKTGNPIATAIAANSGIY

SEQ ID NO: 609 - protein, 767 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGFVLVDNGGTGDVKVAPSNFANGVAEWISSNSRSQAYKVTCSVRQSSANNRKYTVKVEVPKVATQVQGGVELPVAAWRSYMNMELTIPVFATNDDCALIVKALQGTFKTGNPIATAIAANSGIY

SEQ ID NO: 610 - protein, 772 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGFVLVDNGGTGDVKVAPSNFANGVAEWISSNSRSQAYKVTCSVRQSSANNRKYTVKVEVPKVATQVQGGVELPVAAWRSYMNMELTIPVFATNDDCALIVKALQGTFKTGNPIATAIAANSGIY

SEQ ID NO: 611 - protein, 762 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGFVLVDNGGTGDVTVAPSNFANGVAEWISSNSRSQAYKVACSVRQSSAQNRKYTIKVEVPKVATQTVGGVELPVAAWRSYLNMELTIPIFATNSDCELIVKAMQGLLKDGNPIPSAIAANSGIY

SEQ ID NO: 612 - protein, 767 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGFVLVDNGGTGDVTVAPSNFANGVAEWISSNSRSQAYKVACSVRQSSAQNRKYTIKVEVPKVATQTVGGVELPVAAWRSYLNMELTIPIFATNSDCELIVKAMQGLLKDGNPIPSAIAANSGIY

SEQ ID NO: 613 - protein, 772 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGGGGSGGFVLVDNGGTGDVTVAPSNFANGVAEWISSNSRSQAYKVACSVRQSSAQNRKYTIKVEVPKVATQTVGGVELPVAAWRSYLNMELTIPIFATNSDCELIVKAMQGLLKDGNPIPSAIAANSGIY

SEQ ID NO: 614 - protein, 797 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSGGGGSGGMQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 615 - protein, 806 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 616 - protein, 799 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKALEAQKQKLLTEVETYVLSIIPSGPLKAEIAQRLEDVFAGKNTDLEVLMEWLKTRPILSPLTKGILGFVFTLTVPSERGLQRRRFVQNALNGNGDPNNMDKAVKLYRKLKREITFHGAKEISLSYSAGALASCMGLIYNRMGAVTTEVAFGLVCATCEQIADSQ

SEQ ID NO: 617 - protein, 802 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKALEAQKQKEQRLLTEVETYVLSIIPSGPLKAEIAQRLEDVFAGKNTDLEVLMEWLKTRPILSPLTKGILGFVFTLTVPSERGLQRRRFVQNALNGNGDPNNMDKAVKLYRKLKREITFHGAKEISLSYSAGALASCMGLIYNRMGAVTTEVAFGLVCATCEQIADSQ

SEQ ID NO: 618 - protein, 805 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKALEAQKQKEQRQAALLTEVETYVLSIIPSGPLKAEIAQRLEDVFAGKNTDLEVLMEWLKTRPILSPLTKGILGFVFTLTVPSERGLQRRRFVQNALNGNGDPNNMDKAVKLYRKLKREITFHGAKEISLSYSAGALASCMGLIYNRMGAVTTEVAFGLVCATCEQIADSQ

SEQ ID NO: 619 - protein, 808 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKALEAQKQKEQRQAAEELLLTEVETYVLSIIPSGPLKAEIAQRLEDVFAGKNTDLEVLMEWLKTRPILSPLTKGILGFVFTLTVPSERGLQRRRFVQNALNGNGDPNNMDKAVKLYRKLKREITFHGAKEISLSYSAGALASCMGLIYNRMGAVTTEVAFGLVCATCEQIADSQ

SEQ ID NO: 620 - protein, 1079 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGSGMPFITVGQENSTSIDLYYEDHGTGVPVVLIHGFPLSGHSWERQSAALLDAGYRVITYDRRGFGQSSQPTTGYDYDTFAADLNTVLETLDLQDAVLVGFSMGTGEVARYVSSYGTARIAAVAFLASLEPFLLKTDDNPDGAAPQEFFDGIVAAVKADRYAFYTGFFNDFYNLDENLGTRISEEAVRNSWNTAASGGFFAAAAAPTTWYTDFRADIPRIDVPALILHGTGDRTLPIENTARVFHKALPSAEYVEVEGAPHGLLWTHAEEVNTALLAFLAKALEAQKQKLLTEVETYVLSIIPSGPLKAEIAQRLEDVFAGKNTDLEVLMEWLKTRPILSPLTKGILGFVFTLTVPSERGLQRRRFVQNALNGNGDPNNMDKAVKLYRKLKREITFHGAKEISLSYSAGALASCMGLIYNRMGAVTTEVAFGLVCATCEQIADSQ

SEQ ID NO: 621 - protein, 1084 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGSGGGMPFITVGQENSTSIDLYYEDHGTGVPVVLIHGFPLSGHSWERQSAALLDAGYRVITYDRRGFGQSSQPTTGYDYDTFAADLNTVLETLDLQDAVLVGFSMGTGEVARYVSSYGTARIAAVAFLASLEPFLLKTDDNPDGAAPQEFFDGIVAAVKADRYAFYTGFFNDFYNLDENLGTRISEEAVRNSWNTAASGGFFAAAAAPTTWYTDFRADIPRIDVPALILHGTGDRTLPIENTARVFHKALPSAEYVEVEGAPHGLLWTHAEEVNTALLAFLAKALEAQKQKLLTEVETYVLSIIPSGPLKAEIAQRLEDVFAGKNTDLEVLMEWLKTRPILSPLTKGILGFVFTLTVPSERGLQRRRFVQNALNGNGDPNNMDKAVKLYRKLKREITFHGAKEISLSYSAGALASCMGLIYNRMGAVTTEVAFGLVCATCEQIADSQ

SEQ ID NO: 622 - protein, 1085 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSSGSGGMPFITVGQENSTSIDLYYEDHGTGVPVVLIHGFPLSGHSWERQSAALLDAGYRVITYDRRGFGQSSQPTTGYDYDTFAADLNTVLETLDLQDAVLVGFSMGTGEVARYVSSYGTARIAAVAFLASLEPFLLKTDDNPDGAAPQEFFDGIVAAVKADRYAFYTGFFNDFYNLDENLGTRISEEAVRNSWNTAASGGFFAAAAAPTTWYTDFRADIPRIDVPALILHGTGDRTLPIENTARVFHKALPSAEYVEVEGAPHGLLWTHAEEVNTALLAFLAKALEAQKQKLLTEVETYVLSIIPSGPLKAEIAQRLEDVFAGKNTDLEVLMEWLKTRPILSPLTKGILGFVFTLTVPSERGLQRRRFVQNALNGNGDPNNMDKAVKLYRKLKREITFHGAKEISLSYSAGALASCMGLIYNRMGAVTTEVAFGLVCATCEQIADSQ

SEQ ID NO: 623 - protein, 1088 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSSGSGGSGGMPFITVGQENSTSIDLYYEDHGTGVPVVLIHGFPLSGHSWERQSAALLDAGYRVITYDRRGFGQSSQPTTGYDYDTFAADLNTVLETLDLQDAVLVGFSMGTGEVARYVSSYGTARIAAVAFLASLEPFLLKTDDNPDGAAPQEFFDGIVAAVKADRYAFYTGFFNDFYNLDENLGTRISEEAVRNSWNTAASGGFFAAAAAPTTWYTDFRADIPRIDVPALILHGTGDRTLPIENTARVFHKALPSAEYVEVEGAPHGLLWTHAEEVNTALLAFLAKALEAQKQKLLTEVETYVLSIIPSGPLKAEIAQRLEDVFAGKNTDLEVLMEWLKTRPILSPLTKGILGFVFTLTVPSERGLQRRRFVQNALNGNGDPNNMDKAVKLYRKLKREITFHGAKEISLSYSAGALASCMGLIYNRMGAVTTEVAFGLVCATCEQIADSQ

SEQ ID NO: 624 - protein, 1091 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSSGSGGSGGSGGMPFITVGQENSTSIDLYYEDHGTGVPVVLIHGFPLSGHSWERQSAALLDAGYRVITYDRRGFGQSSQPTTGYDYDTFAADLNTVLETLDLQDAVLVGFSMGTGEVARYVSSYGTARIAAVAFLASLEPFLLKTDDNPDGAAPQEFFDGIVAAVKADRYAFYTGFFNDFYNLDENLGTRISEEAVRNSWNTAASGGFFAAAAAPTTWYTDFRADIPRIDVPALILHGTGDRTLPIENTARVFHKALPSAEYVEVEGAPHGLLWTHAEEVNTALLAFLAKALEAQKQKLLTEVETYVLSIIPSGPLKAEIAQRLEDVFAGKNTDLEVLMEWLKTRPILSPLTKGILGFVFTLTVPSERGLQRRRFVQNALNGNGDPNNMDKAVKLYRKLKREITFHGAKEISLSYSAGALASCMGLIYNRMGAVTTEVAFGLVCATCEQIADSQ

SEQ ID NO: 625 - protein, 1094 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGSSGSGGSGGSGGSGGMPFITVGQENSTSIDLYYEDHGTGVPVVLIHGFPLSGHSWERQSAALLDAGYRVITYDRRGFGQSSQPTTGYDYDTFAADLNTVLETLDLQDAVLVGFSMGTGEVARYVSSYGTARIAAVAFLASLEPFLLKTDDNPDGAAPQEFFDGIVAAVKADRYAFYTGFFNDFYNLDENLGTRISEEAVRNSWNTAASGGFFAAAAAPTTWYTDFRADIPRIDVPALILHGTGDRTLPIENTARVFHKALPSAEYVEVEGAPHGLLWTHAEEVNTALLAFLAKALEAQKQKLLTEVETYVLSIIPSGPLKAEIAQRLEDVFAGKNTDLEVLMEWLKTRPILSPLTKGILGFVFTLTVPSERGLQRRRFVQNALNGNGDPNNMDKAVKLYRKLKREITFHGAKEISLSYSAGALASCMGLIYNRMGAVTTEVAFGLVCATCEQIADSQ

SEQ ID NO: 626 - protein, 786 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 627 - protein, 791 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 628 - protein, 786 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 629 - protein, 791 aa, Artificial Sequence
  Recombinant HIV protein
AVGIGAVFLGFLGAAGSTMGAASMTLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 630 - protein, 762 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 631 - protein, 767 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 632 - protein, 767 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALDGGSGGGSGGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 633 - protein, 774 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGVPWNSSWSNRNLSEIWDNMTWLQWDKEISNYTQIIYGLLEESQNQQEKNEQDLLALDGGSGGGSGGGSGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 634 - protein, 754 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 635 - protein, 759 aa, Artificial Sequence
  Recombinant HIV protein
TLTVQARNLLSGIVQQQSNLLRAPEAQQHLLKLTVWGIKQLQARVLAVERYLRDQQLLGIWGCSGKLICTTAGGSGGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGGSGGNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 636 - protein, 785 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVPGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGSGPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 637 - protein, 790 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVPGSGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRGSGPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 638 - protein, 782 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGGSGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRR

SEQ ID NO: 639 - protein, 775 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGGQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRR

SEQ ID NO: 640 - protein, 794 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGSGGSGGQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGGSGGSGGSGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRR

SEQ ID NO: 641 - protein, 777 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGGSGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRR

SEQ ID NO: 642 - protein, 777 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLRGGSGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRR

SEQ ID NO: 643 - protein, 776 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 644 - protein, 781 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGGSGGQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 645 - protein, 776 aa, Artificial Sequence
  Recombinant HIV protein
VFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLDCSTYNNTHNISKEMKICSFNMTTELRDKKRKVNVLFYKLDLVPLTNSSNTTNYRLISCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGGSGGQIYEGKLTAEGLRFGIVASRFNHALVDRLVEGAIDCIVRHGGREEDITLVRVPGSWEIPVAAGELARKEDIDAVIAIGVLIRGATPHFDYIASEVSKGLANLSLELRKPITFGVITADTLEQAIERAGTKHGNKGWEAALSAIEMANLFKSLR

SEQ ID NO: 646 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFACLKCKDKKFNGTGPCPSVSTCQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 647 - protein, 634 aa, Artificial Sequence
  Recombinant HIV protein
AENLWCTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCCNVPWNSSWSNRNLSEIWDNMTWLQWDKEISNYTQIIYGLLEESQNQQEKNEQDLLALD

SEQ ID NO: 648 - protein, 634 aa, Artificial Sequence
  Recombinant HIV protein
AENLWVCVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCCNVPWNSSWSNRNLSEIWDNMTWLQWDKEISNYTQIIYGLLEESQNQQEKNEQDLLALD

SEQ ID NO: 649 - protein, 634 aa, Artificial Sequence
  Recombinant HIV protein
AENLWCTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGCAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 650 - protein, 634 aa, Artificial Sequence
  Recombinant HIV protein
AENLWCTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVACTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 651 - protein, 634 aa, Artificial Sequence
  Recombinant HIV protein
AENLWVCVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVCPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 652 - protein, 634 aa, Artificial Sequence
  Recombinant HIV protein
AENLWVTCYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGCAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 653 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSCITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGCAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 654 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAICQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQACYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 655 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAICQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIFQACYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 656 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAICQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 657 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVDQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 658 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGFKPVVSTQLFLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 659 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFACLKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKCVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 660 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDFWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 661 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTDELRDKKRKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 662 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTCELRDKKCKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 663 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRRGPGDAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 664 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQCNCTRPNNNTRKSIRIGPGQAFYATGDIIGDIRQAHCNCSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 665 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQDNCTRPNNNTRKSIRIGPGQAFYATGDIIGDIRQAHCNRSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 666 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGFEFFYCNTSGLFNSTWISNTSVQGSNSTGSNDSITLPCRIKQIINMWQRIGQAMYAFPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 667 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGFEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 668 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAFPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 669 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPFVSTQFFLNFSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 670 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPFVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 671 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQFLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 672 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLFLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 673 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNWSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 674 - protein, 634 aa, Artificial Sequence
  Recombinant HIV protein
AENLWVTVYYGVPVWKDAETTLFCFSDAKAYETEKHNVWATHACFPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 675 - protein, 634 aa, Artificial Sequence
  Recombinant HIV protein
AENLWVTVYYGVPVWKDAETTLFCASDAKAYETEKHNVWATHACVPFDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTFQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 676 - protein, 634 aa, Artificial Sequence
  Recombinant HIV protein
AENLWVTVYYGVPVWKDAETTLFCASDAKAYETEKHNVWATHACVPFDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 677 - protein, 634 aa, Artificial Sequence
  Recombinant HIV protein
AENLWVTVYYGVPVWKDAETTLFCAHDAKAYETEKHNVWATHACVETDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 678 - protein, 634 aa, Artificial Sequence
  Recombinant HIV protein
AENLWVTVYYGVPVWKDAETTLFCFSDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 679 - protein, 634 aa, Artificial Sequence
  Recombinant HIV protein
AENLWVTVYYGVPVWKDAETTLFCFSDAKAYETEKHNVWATHACVPTDPNWQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 680 - protein, 634 aa, Artificial Sequence
  Recombinant HIV protein
AENLWVTVYYGVPVWKDAETTFFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPWHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 681 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIKSLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWERIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 682 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSCQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHCFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 683 - protein, 634 aa, Artificial Sequence
  Recombinant HIV protein
AENLWVTVYYGVPVWKDAETTLFCCSDAKAYETEKHNVWATHACVPCDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 684 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPFCVTLQCTNVTNNITDDMRGELKNCSFNMTTELRDKKQKVYSLFYRLDVVQINENQGNRSNNSNKEYRWINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 685 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPFCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 686 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTWNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 687 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTWNITDDMRGEWKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 688 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRFICCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQCINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 689 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDWIGDFRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 690 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDWIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 691 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDFRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 692 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDFRDFWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 693 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLHCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 694 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEDMHKDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 695 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIIHLWDESLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 696 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDFRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDWRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 697 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISWWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 698 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQFCPKWSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 699 - protein, 634 aa, Artificial Sequence
  Recombinant HIV protein
AENLWVTVYYCVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTCTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 700 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTFQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 701 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPWCVTLQCTNVTNNITDDMRGELKNCSFNMTTELRDKKQKVYSLFYRLDVVQINENQGNRSNNSNKEYRLWNCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 702 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNIWIDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIIWIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 703 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVWSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 704 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRWDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 705 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSFFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 706 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSWFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 707 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGFLKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 708 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGWLKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 709 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEFKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 710 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEWKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 711 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTFLRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 712 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTWLRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 713 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNFSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 714 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAIFQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 715 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAIWQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 716 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQFCPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 717 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQFINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 718 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQWINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 719 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGFAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 720 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGWAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 721 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYMPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 722 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYFPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 723 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYWPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 724 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQWCPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 725 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNFTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 726 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNWTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 727 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSWRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 728 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSFRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 729 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSAEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 730 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLWYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDYIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 731 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEWKNCSFNMTTELRDKKQKVYSLWYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 732 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEWKNCSYNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 733 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLWYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 734 - protein, 634 aa, Artificial Sequence
  Recombinant HIV protein
AENLWVTVYYCVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAAGSTMGAASMTCTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 735 - protein, 634 aa, Artificial Sequence
  Recombinant HIV protein
AENLWVTVYYCVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAAGSTMGAASMTLTVQCRNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 736 - protein, 634 aa, Artificial Sequence
  Recombinant HIV protein
AENLWVTVYYGVCVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGACGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 737 - protein, 634 aa, Artificial Sequence
  Recombinant HIV protein
AENLWVTVYYGVPVWKDAETTLFCASDAKAYETEKHNVWATHCCVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAIEAQQHLLKLTVWCIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 738 - protein, 634 aa, Artificial Sequence
  Recombinant HIV protein
AENLWVTVYYGVPVWKDAETTLFCASDAKAYETEKHNVWATHACVPTDPNPQECHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFCGFLGAAGSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 739 - protein, 634 aa, Artificial Sequence
  Recombinant HIV protein
AENLWVTVYYGVPVWKDAETTLFCASDAKAYETEKHNVWATHACVPTDPNPQEIHLENCTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAACSTMGAASMTLTVQARNLLSGIVQQQSNLLRAIEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 740 - protein, 634 aa, Artificial Sequence
  Recombinant HIV protein
AENLWVTVYYGVPVWKDAETTLFCASDAKAYETEKHNVWATHCCVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWCIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 741 - protein, 634 aa, Artificial Sequence
  Recombinant HIV protein
AENLWVTVYYGVPVWKDAETTLFCASDAKAYETEKHNVWATHACVPTDPNPQECHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFCGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 742 - protein, 634 aa, Artificial Sequence
  Recombinant HIV protein
AENLWVTVYYGVPVWKDAETTLFCASDAKAYETEKHNVWATHACVPTDPNPQEIHLENCTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCTNSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRAKRRVVGRRRRRRAVGIGAVFLGFLGAACSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALD

SEQ ID NO: 743 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTCKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPICGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 744 - protein, 909 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDEPKIPQPQPKPQPQPQPQPKPQPKPEPECTCPKCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGSGGPTLYNVSLVMSDTAGTCY

SEQ ID NO: 745 - protein, 835 aa, Human immunodeficiency virus
MRVRGIMRNWQQWWIWGSLGFWMLIICNVMGSLWVTVYYGVPVWREAKTTLFCASDAKAYETEAHSVWATHACVPTDPNPQEMVLENVTENFNMWKNDMVDQMHEDVISIWDQSLKPCVKLTPLCVTLDCSTYNNTHNISKEMKICSFNMTTELRDKKRKVNVLFYKLDLVPLTNSSNTTNYRLISCNTSTITQACPKVSFDPIPIHYCAPAGYAILKCNNKTFNGTGPCNNVSTVQCTHGIKPVVSTQLLLNGSLAEEEIIIRFENLTDNVKIIIVQLNETINITCTRPNNNTRKSIRIGPGQSFYATGEIVGNIREAHCNISASKWNKTLERVRTKLKEHFPNKTIEFEPSSGGDLEITTHSFNCGGEFFYCNTSGLFNSAINGTLTSNVTLPCRIKQIINMWQEVGRAMYAPPIAGNITCKSNITGLLLTRDGGENSSSTTETFRPTGGDMKNNWRSELYKYKVVEIKPLGIAPTEAKRRVVEREKRAVGIGAVFLGFLGAAGSTMGAASMTLTVQARQLLSGIVQQQSNLLKAIEAQQHMLQLTVWGIKQLQARVLAIERYLKDQQLLGLWGCSGKLICTTNVPWNASWSNKSKNDIWDNMTWMQWDREISNHTDTIYRLLEDSQNQQEKNEKDLLALDSWKNLWNWFSITKWLWYIKIFIMIVGGLIGLRIIFAVLSIVNRVRQGYSPLSFQTLTPNPRGPDRLGGIEEEGGEQDKNKSRRLVTGFLPVVWDDLRSLCLFSYHLLRDFILIVARTVELLGRRGWEALKYLGGLVQYWGLELKKSTISLLDTIAIVVAEGTDRIIEVLQRIGRAIYNIPRRIRQGFETALL

SEQ ID NO: 746 - protein, 853 aa, Human immunodeficiency virus
MRVMGIQRNCQHLLTWGIMILGTIIFCSAVENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNVTSVNTTGDREGLKNCSFNMTTELRDKRQKVYSLFYRLDIVPINENQGSEYRLINCNTSAITQACPKVSFEPIPIHYCTPAGFAILKCKDEGFNGTGLCKNVSTVQCTHGIKPVVSTQLLLNGSLAEKNITIRSENITNNAKIIIVQLVQPVTIKCIRPNNNTRKSIRIGPGQAFYATGDIIGDIRQAHCNVTRSRWNKTLQEVAEKLRTYFGNKTIIFANSSGGDLEITTHSFNCGGEFFYCNTSGLFNSTWYVNSTWNDTDSTQESNDTITLPCRIKQIINMWQRAGQAMYAPPIPGVIKCESNITGLLLTRDGGKDNNVNETFRPGGGDMRDNWRSELYKYKVVEIEPLGVAPTRAKRRVVEREKRAVGIGAVFLGFLGAAGSTMGATSITLTVQARQLLSGIVQQQNNLLRAIEAQQHLLKLTVWGIKQLQARVLAVERYLRDQQLLGIWGCSGKLICTTNVPWNSSWSNKSLDEIWNNMTWLQWDKEINNYTQLIYRLIEESQNQQEKNEKELLELDKWANLWSWFDISNWLWYIKIFIIIVGGLIGLRIVFAVLSVINRVRQGYSPLSFQTHTPNPRGLDRPERIEEEDGEQGRGRSIRLVSGFLALAWDDLRSLCLFSYHRLRDFILIAARTVELLGHSSLKGLRLGWEGIKYLWNLLSYWGRELKISAINLVDTIAIAVAGWTDRVIEIAQRIGRAILHIPVRIRQGLERALL

SEQ ID NO: 747 - protein, 864 aa, Human immunodeficiency virus
MRVKETQMNWPNLWKWGTLILGLVIICSASDNLWVTVYYGVPVWRDADTTLFCASDAKAHETEVHNVWATHACVPTDPNPQEIDLENVTENFNMWKNNMVEQMQEDVISLWDQSLKPCVKLTPLCVTLHCTNANLTKANLTNVNNRTNVSNIIGNITDEVRNCSFNMTTELRDKKQKVHALFYKLDIVPIEDNNDNSKYRLINCNTSVIKQACPKISFDPIPIHYCTPAGYAILKCNDKNFNGTGPCKNVSSVQCTHGIKPVVSTQLLLNGSLAEEEIIIRSEDLTNNAKTIIVHLNKSVVINCTRPSNNTRTSITIGPGQVFYRTGDIIGDIRKAYCEINGTEWNKALKQVTEKLKEHFNNKPIIFQPPSGGDLEITMHHFNCRGEFFYCNTTRLFNNTCIANGTIEGCNGNITLPCKIKQIINMWQGAGQAMYAPPISGTINCVSNITGILLTRDGGATNNTNNETFRPGGGNIKDNWRNELYKYKVVQIEPLGAAPTRAKRRVVEREKRAVGIGAMIFGFLGAAGSTMGAASITLTVQARQLLSGIVQQQSNLLRAIEAQQHLLQLTVWGIKQLQARVLAVERYLKDQKFLGLWGCSGKIICTTAVPWNSTWSNKSLEEIWNNMTWIEWEREISNYTNQIYEILTKSQDQQDRNEKDLLELDKWASLWTWFDITNWLWYIKIFIMIVGGLIGLRIIFAVLSIVNRVRQGYSPLSFQTPCHHQREPDRPERIEEEGGEQGRDRSVRLVSGFLALAWDDLRSLCLFSYHRLRDFILIAARTVELLGRSSLKGLRRGWEGLKYLGNLLLYWGQELKISAISLLDATAIAVAGWTDRVIEVAQGAWKAILHIPRRIRQGLERALQ

SEQ ID NO: 748 - protein, 849 aa, Human immunodeficiency virus
MKVMGTKKNYQHLWRWGIMLLGMLMMSSAAEQLWVTVYYGVPVWREANTTLFCASDAKAYDTEVHNVWATHACVPTDPNPQEVVMGNVTEDFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTSVITQACPKVSFEPIPIHYCAPAGFAILKCNNKTFNGKGPCRNVSTVQCTHGIKPVVSTQLLLNGSLAEEDIIIRSENFTNNGKNIIVQLKEPVKINCTRPGNNTRRSINIGPGRAFYATGAIIGDIRKAHCNISTEQWNNTLTQIVDKLREQFGNKTIIFNQSSGGDPEVVMHTFNCGGEFFYCNSTQLFNSTWFNNGTSTWNSTADNITLPCRIKQVINMWQEVGKAMYAPPIRGQIDCSSNITGLILTRDGGSNSSQNETFRPGGGNMKDNWRSELYKYKVVKIEPLGIAPTRAKRRVVQREKRAVTLGAVFLGFLGAAGSTMGAASLTLTVQARLLLSGIVQQQSNLLRAIEAQQHMLQLTVWGIKQLQARVLAIERYLKDQQLLGIWGCSGKLICTTTVPWNTSWSNKSYDYIWNNMTWMQWEREIDNYTGFIYTLIEESQNQQEKNELELLELDKWASLWNWFNITNWLWYIKLFIMIIGGLVGLRIVCAVLSIVNRVRQGYSPLSFQTRLPNPRGPDRPEETEGEGGERDRDRSARLVNGFLAIIWDDLRSLCLFSYHRLRDLLLIVARVVEILGRRGWEILKYWWNLLKYWSQELKNSAVSLLNVTAIAVAEGTDRVIEIVQRAVRAILHIPTRIRQGFERALL

SEQ ID NO: 749 - protein, 814 aa, Human immunodeficiency virus
VVGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVEREKRAVGLGAMFLGFLGAAGSTMGAASITLTVQARQLLSGIVQQQNNLLRAIEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALDSWNNLWNWFDISNWLWYIKIFIMIVGGLIGLRIIFAVLSIVNRVRQGYSPLSFQTLTQNPRGLDRLGRIEEEGGEQDRDRSVRLVNGFLALFWDDLRSLCLFSYHRLRDFILIATRVVELLGRSSLKGLQRGWEALRYLGSRVQYWGLELKKSAISLFDTIAIAVAEGTDRIIELIQRSWRAIRNIPRRIRQGFETALL

SEQ ID NO: 750 - protein, 848 aa, Human immunodeficiency virus
VGGNMWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVEIKPLGVAPTEAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSHEEIWNNMTWMQWDREISNYTNIIYNLLEESQNQQERNEKDLLALDSWKNLWNWFNITNWLWYIKLFIMIVGGLIGLRIIFAVLSIVNRVRQGYSPLPFQIRTPNPGGPDRLGRIEEDGGEQDKDRSIRLVSGFLALAWDDLRSLCLFSYHRLRDFILVTARVVELLGRSSLRGLQKGWEALKYLGSLVQYWGLELKKSATSLFDTIAIAVAEGTDRIIELGLSICRAIRHIPRRIRQGFEAALQ

SEQ ID NO: 751 - protein, 820 aa, Human immunodeficiency virus
ATEKLWVTVYYGVPVWREAKATLFCASDAKAYDTEVHNVWATHACVPTDPNPQEIILENVTENFNMWKNNMVEQMHEDIISLWDQSLKPCVKLTPLCVTLNCTDVTVNGTIVKVNSTGMKNCSFNITTEIRDKKKKESALFYRLDIVPLDESSDSSSNYSEYRLISCNTSTITQACPKVTFDPIPIHYCAPAGYAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRAIYAPPIAGNITCTSDITGLLLTRDGGSDGNSTKETFRPGGGDMRDNWRSELYKYKVVEIKPLGVAPTKAKRRVVEREKRAVGIGAVFFGFLGAAGSTMGAASITLTVQARQLLSGIVQQQSNLLRAIEAQQHMLQLTVWGIKQLQTRVLAIERYLKDQQLLGIWGCSGKLICTTTVPWNSSWSNKTQNDIWDNMTWMQWDREINNYTNTIYRLLEESQNQQEKNEQDLLALDKWDNLWSWFSITKWLWYIKIFIMIVGGLIGLRIIFAVLSIVNRVRQGYSPLSFQTLIPSPREPDRPGRIEEEGGEQDRNRSTRLVSGFLALAWDDLRSLCLFSYHLLRDFILIAARTVELLGRSSLRGLQRGWETLKYLGSLVQYWGLELKKSAISLFDTIAIHVAEGTDRIIELVQGICRAIYNIPVRIRQGFEAALQ

SEQ ID NO: 752 - protein, 26 aa, Artificial Sequence
  Foldon domain
GYIPEAPRDGQCYVRCDGEWVLLSTF

SEQ ID NO: 753 - protein, 26 aa, Artificial Sequence
  Foldon domain
GYIPECPRDGQAYVCKDGEWVLLSTF

SEQ ID NO: 754 - protein, 26 aa, Artificial Sequence
  Foldon domain
GYIPEAPRDGQCYCRKDGEWVLLSTF

SEQ ID NO: 755 - protein, 26 aa, Artificial Sequence
  Foldon domain
GYIPEAPRDGQACVRKDGECVLLSTF

SEQ ID NO: 756 - protein, 265 aa, Artificial Sequence [sequence omitted]

SEQ ID NO: 757 - DNA, 1914 bp, Artificial sequence
  recombinant HIV DNA
gccgaaaacctgtgggtcaccgtgtattatggagtgcccgtctggaaagatgctgaaactaccctgttctgtgcctctgatgctaaggcctacgagaccgaaaagcacaatgtctgggctactcatgcatgcgtgcccaccgacccaaacccccaggagatccacctggaaaatgtgaccgaggaattcaacatgtggaaaaacaatatggtggagcagatgcatacagacatcattagcctgtgggatcagtccctgaagccctgcgtcaaactgactcctctgtgcgtgaccctgcagtgtaccaatgtcacaaacaatatcaccgacgatatgaggggcgagctgaagaattgtagcttcaacatgaccacagaactgagagacaagaaacagaaagtgtactccctgttttataggctggatgtggtccagatcaatgagaaccaggggaatcggagcaacaattccaacaaggaatacagactgatcaattgcaacacttccgccattacccaggcttgtcctaaagtgtcttttgagcctatcccaattcattattgcgccccagctggcttcgccatcctgaagtgtaaagataagaagttcaacggaactggcccctgcccttccgtgtctacagtccagtgtactcacgggattaagcctgtggtctctacacagctgctgctgaatggaagtctggctgaggaagaagtgatgatccggagcgagaacattaccaacaatgccaagaatatcctggtccagttcaacacaccagtgcagattaattgcacaagacccaacaataacactcgaaaatctatccggattgggccaggacaggccttttacgctacaggggacatcattggagatatcagacaggctcactgtaatgtgagtaaggcaacctggaacgagacactgggcaaggtggtcaaacagctgaggaaacatttcgggaataacaccatcattcgctttgccaatagctccggaggggacctggaggtcactacccactccttcaactgcggaggcgaattcttttactgtaacacatctggcctgtttaatagtacatggatctctaacactagtgtgcagggcagtaattcaactgggtcaaacgatagcatcaccctgccatgccgaattaagcagatcattaatatgtggcagcggatcggccaggcaatgtatgccccccctatccagggggtcattcgctgcgtgagcaatatcaccggactgattctgacacgagacgggggcagcaccaactctacaactgaaacattccggcccggcgggggagacatgagagataactggaggtccgagctgtacaagtataaagtggtcaagatcgaacctctgggagtggcaccaaccagatgcaagcgaagagtggtcggaggaggatccggaggtggcggttctggaggcgcagtcggaattggggccgtgttcctgggatttctgggcgccgctgggagtacaatgggagcagcctcaatgactctgaccgtgcaggccaggaatctgctgagcggcatcgtccagcagcagtccaacctgctgcgcgctcctgaagcacagcagcacctgctgaagctgaccgtgtggggcatcaaacagctgcaggctagggtgctggcagtcgagcggtacctgagagaccagcagctgctgggaatctggggctgctctgggaagctgatttgttgcacaaatgtgccttggaactctagttggtcaaatcgcaacctgagcgagatctgggacaatatgacttggctgcagtgggataaagaaattagtaactacacccagatcatctacggcctgctggaagagtcacagaatcagcaggagaagaacgaacaggacctgctggcactggat

SEQ ID NO: 758 - protein, 27 aa, Human immunodeficiency virus
KIFIMIVGGLIGLRIVFAVLSVIHRVR

SEQ ID NO: 759 - DNA, 82 bp, Human immunodeficiency virus
aaaaatatttataatgatagtaggaggcttaataggattaagaatagtttttgctgtgctttctgtaatacatagagttagg

SEQ ID NO: 760 - protein, 23 aa, Influenza A virus
ILAIYSTVASSLVLLVSLGAISF

SEQ ID NO: 761 - DNA, 69 bp, Influenza A virus
atcctggccatctacagcaccgtggccagcagcctggtgctgctggtgagcctgggcgccatcagcttc

SEQ ID NO: 762 - protein, 29 aa, Influenza A virus
IITIGSICMVVGIISLILQIGNIISIWVS

SEQ ID NO: 763 - DNA, 87 bp, Influenza A virus
atcatcaccatcggcagcatctgcatggtggtgggcatcatcagcctgatcctgcagatcggcaacatcatcagcatctgggtgtcc

SEQ ID NO: 764 - protein, 628 aa, Artificial Sequence
  Recombinant HIV protein
AENLWVTVYYGVPVWREAKTTLFCASDAKSYEKEVHNVWATHACVPTDPNPQELVLKNVTENFNMWKNDMVDQMHEDIISLWDQSLKPCVKLTPLCVTLNCSDAKVNINATYNGTREEIKNCSFNATTELRDKKKKEYALFYRLDIVPLNKEGNNNSEYRLINCNTSVCTQACPKVTFDPIPIHYCAPAGYAILKCNNKTFNGTGPCNNVSTVQCTHGIKPVVSTQLLLNGSLAEEEIIIRSENLTDNVKTIIVHLNESVEINCTRPNNNTRKSIRIGPGQTFYATGDIIGDIRQAHCNISEIKWEKTLQRVSEKLREHFNKTIIFNQSSGGDLEITTHSFNCGGEFFYCNTSDLFFNKTFDETYSTGSNSTNSTITLPCRIKQIINMWQEVGRCMYASPIAGEITCKSNITGLLLTRDGGGNNSTEETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 765 - protein, 622 aa, Artificial Sequence
  Recombinant HIV protein
AENLWVTVYYGVPVWREAKATLFCASDAKAYDTEVHNVWATHACVPTDPNPQEIILENVTENFNMWKNNMVEQMHEDIISLWDQSLKPCVKLTPLCVTLNCTDVTVNGTIVKVNSTGMKNCSFNITTEIRDKKKKESALFYRLDIVPLDESSDSSSNYSEYRLISCNTSTCTQACPKVTFDPIPIHYCAPAGYAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRCIYAPPIAGNITCTSDITGLLLTRDGGSDGNSTKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 766 - protein, 616 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 767 - protein, 628 aa, Artificial Sequence
  Recombinant HIV protein
AENLWVTVYYGVPVWKDAETTLFCASDAKSYEKEVHNVWATHACVPTDPNPQEIHLENVTENFNMWKNNMVEQMHTDIISLWDQSLKPCVKLTPLCVTLNCSDAKVNINATYNGTREEIKNCSFNATTELRDKKKKEYALFYRLDIVPLNKEGNNNSEYRLINCNTSVCTQACPKVTFDPIPIHYCAPAGFAILKCNNKTFNGTGPCNNVSTVQCTHGIKPVVSTQLLLNGSLAEEEIIIRSENLTDNVKTIIVHLNESVEINCTRPNNNTRKSIRIGPGQTFYATGDIIGDIRQAHCNISEIKWEKTLQRVSEKLREHFNKTIIFNQSSGGDLEITTHSFNCGGEFFYCNTSDLFFNKTFDETYSTGSNSTNSTITLPCRIKQIINMWQEVGRCMYASPIAGEITCKSNITGLLLTRDGGGNNSTEETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 768 - protein, 622 aa, Artificial Sequence
  Recombinant HIV protein
AENLWVTVYYGVPVWKDAETTLFCASDAKAYDTEVHNVWATHACVPTDPNPQEIHLENVTENFNMWKNNMVEQMHTDIISLWDQSLKPCVKLTPLCVTLNCTDVTVNGTIVKVNSTGMKNCSFNITTEIRDKKKKESALFYRLDIVPLDESSDSSSNYSEYRLISCNTSTCTQACPKVTFDPIPIHYCAPAGFAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRCIYAPPIAGNITCTSDITGLLLTRDGGSDGNSTKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 769 - protein, 616 aa, Artificial Sequence
  Recombinant HIV protein
AENLWVTVYYGVPVWKDAETTLFCASDAKAYEREVHNVWATHACVPTDPNPQEIHLENVTENFNMWKNNMVEQMQTDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGFAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 770 - protein, 650 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 771 - protein, 650 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTCKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPICGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 772 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVLLGFLGAAGSTMGAASITLTVQARQLLSGIVQQQSNLLRAPEAQQHMLQLTVWGIKQLQTRVLAIERYLKDQQLLGLWGCSGKLICCTNVPWNSSWSNKSQTDIWDNMTWIQWDREISNYSNTIYKLLEGSQNQQEQNEKDLLALD

SEQ ID NO: 773 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 774 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKPMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 775 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGPAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 776 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYCLFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYCTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 777 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLICCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 778 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTCVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 779 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTCKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPICGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 780 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGWAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 781 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGYDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 782 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVPKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 783 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIICMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 784 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCCKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGCAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 785 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKCTPLCVTLNCKDVNATNTTNDSEGTMERGEIKNCSFNITTSIRDKVQKEYALFYKLDVVPIDNNNTSYRLISCDTSVITCACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 786 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTCKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPICGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 787 - protein, 628 aa, Artificial Sequence; identical to SEQ ID NO: 779
  Recombinant HIV protein

SEQ ID NO: 788 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITCACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRACYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 789 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKCTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRACYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 790 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFCTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYACPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 791 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKCYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSCHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 792 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACCKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFCTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 793 - protein, 628 aa, Artificial Sequence; identical to SEQ ID NO: 776
  Recombinant HIV protein

SEQ ID NO: 794 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTCIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSICIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 795 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYACFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTCGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 796 - protein, 628 aa, Artificial Sequence
  Recombinant HIV protein
VEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTCGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPCIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 797 - protein, 299 aa, Artificial Sequence
  Recombinant HIV protein
VKLTPLCVTLNCINANVTNSSMTNSSMMEGEIKNCSYNMTTELRDKKRKVFSLFYKLDVVPMNENNSEYRLINCNTSCITQGGSGFYATGAITGDIRQAYAGSGAARPSNNTRKSVHIGPCGGSGGGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 798 - protein, 294 aa, Artificial Sequence
  Recombinant HIV protein
VKLTPLCVTLNCINANVTNSSMTNSSMMEGEIKNCSYNMTTELRDKKRKVFSLFYKLDVVPMNENNSEYRLINCNTSCITQGGSGFYATGAITGDIRQAYAGSGAARPSNNTRKSVHIGPCGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 799 - protein, 289 aa, Artificial Sequence
  Recombinant HIV protein
VKLTPLCVTLNCINANVTNSSMTNSSMMEGEIKNCSYNMTTELRDKKRKVFSLFYKLDVVPMNENNSEYRLINCNTSCITQGGSGFYATGAITGDIRQAYAGSGAARPSNNTRKSVHIGPCGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 800 - protein, 296 aa, Artificial Sequence
  Recombinant HIV protein
VKLTPLCVTLHCTNVTSVNTTGDREGLKNCSFNMTTELRDKRQKVYSLFYRLDIVPINENQGSEYRLINCNTSCITQGGSGFYATGDIIGDIRQAHAAGSGAIRPNNNTRKSIRIGPCGGSGGGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 801 - protein, 291 aa, Artificial Sequence
  Recombinant HIV protein
VKLTPLCVTLHCTNVTSVNTTGDREGLKNCSFNMTTELRDKRQKVYSLFYRLDIVPINENQGSEYRLINCNTSCITQGGSGFYATGDIIGDIRQAHAAGSGAIRPNNNTRKSIRIGPCGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 802 - protein, 286 aa, Artificial Sequence
  Recombinant HIV protein
VKLTPLCVTLHCTNVTSVNTTGDREGLKNCSFNMTTELRDKRQKVYSLFYRLDIVPINENQGSEYRLINCNTSCITQGGSGFYATGDIIGDIRQAHAAGSGAIRPNNNTRKSIRIGPCGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 803 - protein, 290 aa, Artificial Sequence
  Recombinant HIV protein
VKLTPLCVTLNCINANVTNSSMTNSSMMEGEIKNCSYNMTTELRDKKRKVFSLFYKLDVVPMNENNSEYRLINCNTSCITQGGSGFYATGAITGDIRQAYAGSGAARPSNNTRKSVHIGPCGGSGGGGSGGGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 804 - protein, 285 aa, Artificial Sequence
  Recombinant HIV protein
VKLTPLCVTLNCINANVTNSSMTNSSMMEGEIKNCSYNMTTELRDKKRKVFSLFYKLDVVPMNENNSEYRLINCNTSCITQGGSGFYATGAITGDIRQAYAGSGAARPSNNTRKSVHIGPCGGSGGGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 805 - protein, 280 aa, Artificial Sequence
  Recombinant HIV protein
VKLTPLCVTLNCINANVTNSSMTNSSMMEGEIKNCSYNMTTELRDKKRKVFSLFYKLDVVPMNENNSEYRLINCNTSCITQGGSGFYATGAITGDIRQAYAGSGAARPSNNTRKSVHIGPCGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 806 - protein, 287 aa, Artificial Sequence
  Recombinant HIV protein
VKLTPLCVTLHCTNVTSVNTTGDREGLKNCSFNMTTELRDKRQKVYSLFYRLDIVPINENQGSEYRLINCNTSCITQGGSGFYATGDIIGDIRQAHAAGSGAIRPNNNTRKSIRIGPCGGSGGGGSGGGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 807 - protein, 282 aa, Artificial Sequence
  Recombinant HIV protein
VKLTPLCVTLHCTNVTSVNTTGDREGLKNCSFNMTTELRDKRQKVYSLFYRLDIVPINENQGSEYRLINCNTSCITQGGSGFYATGDIIGDIRQAHAAGSGAIRPNNNTRKSIRIGPCGGSGGGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 808 - protein, 277 aa, Artificial Sequence
  Recombinant HIV protein
VKLTPLCVTLHCTNVTSVNTTGDREGLKNCSFNMTTELRDKRQKVYSLFYRLDIVPINENQGSEYRLINCNTSCITQGGSGFYATGDIIGDIRQAHAAGSGAIRPNNNTRKSIRIGPCGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 809 - protein, 299 aa, Artificial Sequence
  Recombinant HIV protein
VKLTPLCVTLNCINANVTNSSMTNSSMMEGEIKNCSYNMTTELRDKKRKVFSCFYKLDVVPMNENNSEYRLINCNTSCITQGGSGFYACGAITGDIRQAYAGSGAARPSNNTRKSVHIGPCGGSGGGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 810 - protein, 294 aa, Artificial Sequence
  Recombinant HIV protein
VKLTPLCVTLNCINANVTNSSMTNSSMMEGEIKNCSYNMTTELRDKKRKVFSCFYKLDVVPMNENNSEYRLINCNTSCITQGGSGFYACGAITGDIRQAYAGSGAARPSNNTRKSVHIGPCGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 811 - protein, 289 aa, Artificial Sequence
  Recombinant HIV protein
VKLTPLCVTLNCINANVTNSSMTNSSMMEGEIKNCSYNMTTELRDKKRKVFSCFYKLDVVPMNENNSEYRLINCNTSCITQGGSGFYACGAITGDIRQAYAGSGAARPSNNTRKSVHIGPCGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 812 - protein, 296 aa, Artificial Sequence
  Recombinant HIV protein
VKLTPLCVTLHCTNVTSVNTTGDREGLKNCSFNMTTELRDKRQKVYCLFYRLDIVPINENQGSEYRLINCNTSCITQGGSGFYCTGDIIGDIRQAHAAGSGAIRPNNNTRKSIRIGPCGGSGGGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 813 - protein, 291 aa, Artificial Sequence
  Recombinant HIV protein
VKLTPLCVTLHCTNVTSVNTTGDREGLKNCSFNMTTELRDKRQKVYCLFYRLDIVPINENQGSEYRLINCNTSCITQGGSGFYCTGDIIGDIRQAHAAGSGAIRPNNNTRKSIRIGPCGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 814 - protein, 286 aa, Artificial Sequence
  Recombinant HIV protein
VKLTPLCVTLHCTNVTSVNTTGDREGLKNCSFNMTTELRDKRQKVYCLFYRLDIVPINENQGSEYRLINCNTSCITQGGSGFYCTGDIIGDIRQAHAAGSGAIRPNNNTRKSIRIGPCGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 815 - protein, 290 aa, Artificial Sequence
  Recombinant HIV protein
VKLTPLCVTLNCINANVTNSSMTNSSMMEGEIKNCSYNMTTELRDKKRKVFSCFYKLDVVPMNENNSEYRLINCNTSCITQGGSGFYACGAITGDIRQAYAGSGAARPSNNTRKSVHIGPCGGSGGGGSGGGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 816 - protein, 285 aa, Artificial Sequence
  Recombinant HIV protein
VKLTPLCVTLNCINANVTNSSMTNSSMMEGEIKNCSYNMTTELRDKKRKVFSCFYKLDVVPMNENNSEYRLINCNTSCITQGGSGFYACGAITGDIRQAYAGSGAARPSNNTRKSVHIGPCGGSGGGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 817 - protein, 280 aa, Artificial Sequence
  Recombinant HIV protein
VKLTPLCVTLNCINANVTNSSMTNSSMMEGEIKNCSYNMTTELRDKKRKVFSCFYKLDVVPMNENNSEYRLINCNTSCITQGGSGFYACGAITGDIRQAYAGSGAARPSNNTRKSVHIGPCGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 818 - protein, 287 aa, Artificial Sequence
  Recombinant HIV protein
VKLTPLCVTLHCTNVTSVNTTGDREGLKNCSFNMTTELRDKRQKVYCLFYRLDIVPINENQGSEYRLINCNTSCITQGGSGFYCTGDIIGDIRQAHAAGSGAIRPNNNTRKSIRIGPCGGSGGGGSGGGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 819 - protein, 282 aa, Artificial Sequence
  Recombinant HIV protein
VKLTPLCVTLHCTNVTSVNTTGDREGLKNCSFNMTTELRDKRQKVYCLFYRLDIVPINENQGSEYRLINCNTSCITQGGSGFYCTGDIIGDIRQAHAAGSGAIRPNNNTRKSIRIGPCGGSGGGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 820 - protein, 277 aa, Artificial Sequence
  Recombinant HIV protein
VKLTPLCVTLHCTNVTSVNTTGDREGLKNCSFNMTTELRDKRQKVYCLFYRLDIVPINENQGSEYRLINCNTSCITQGGSGFYCTGDIIGDIRQAHAAGSGAIRPNNNTRKSIRIGPCGGSGGMQIYEGKLTAEGLRFGIVASRFNHALVDRLVEGAIDAIVRHGGREEDITLVRVPGSWEIPVAAGELARKEDIDAVIAIGVLIRGATPHFDYIASEVSKGLADLSLELRKPITFGVITADTLEQAIERAGTKHGNKGWEAALSAIEMANLFKSLR

SEQ ID NO: 821 - protein, 300 aa, Artificial Sequence
  Recombinant HIV protein
CVKLTPLCVTLQCTNVTNGGSGGGGSGGCTRPNNNTRKSIRIGPGQAFYATGDIIGDIRQAHCGGSGGGGSGGRGELKNCSFNMTTELRDKKQKVYSLFYRLDVVQINENQGNRSNNSNKEYRLINCNTSAITQACGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 822 - protein, 292 aa, Artificial Sequence
  Recombinant HIV protein
CVKLTPLCVTLDCKNVTLGGSGGGGSGGCTRPNNNTRKSIRIGPGQTFYATGEIIGDIRQAHCGGSGGGGSGGVKELRNCSFNATTEVRDKKKKEYALFYSLDIVPLKNSSEQYRLISCDTSAITQACGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 823 - protein, 298 aa, Artificial Sequence
  Recombinant HIV protein
CVKLTPLCVTLNCTDVTVGGSGGGGSGGCTRPNNNTRKSMRIGPGQTFYATGEIIGDIRQAHCGGSGGGGSGGSTGMKNCSFNITTEIRDKKKKESALFYRLDIVPLDESSDSSSNYSEYRLISCNTSTITQACGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 824 - protein, 294 aa, Artificial Sequence
  Recombinant HIV protein
CVKLTPLCVTLNCSKLNNGGSGGGGSGGCTRPGNNTRKSIRIGPGQAFFATTNIIGDIRQAYCGGSGGGGSGGDGEMKNCSFNATTELWDKKKQVYALFYKLDIVPLDGRNNSSEYRLINCNTSTITQACGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 825 - protein, 294 aa, Artificial Sequence
  Recombinant HIV protein
CVKLTPLCVTLDCSTYNNGGSGGGGSGGCTRPNNNTRKSIRIGPGQSFYATGEIVGNIREAHCGGSGGGGSGGSKEMKICSFNMTTELRDKKRKVNVLFYKLDLVPLTNSSNTTNYRLISCNTSTCTQACGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 826 - protein, 304 aa, Artificial Sequence
  Recombinant HIV protein
CVKLTPLCVTLQCTNVTNGGSGGGGSGGCTRPNNNTRKSIRIGPGQAFYATGDIIGDIRQAHCGGSGGGGSGGRGELKNCSFNMTTELRDKKQKVYSLFYRLDVVQINENQGNRSNNSNKEYRLINCNTSAITQACGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 827 - protein, 296 aa, Artificial Sequence
  Recombinant HIV protein
CVKLTPLCVTLDCKNVTLGGSGGGGSGGCTRPNNNTRKSIRIGPGQTFYATGEIIGDIRQAHCGGSGGGGSGGVKELRNCSFNATTEVRDKKKKEYALFYSLDIVPLKNSSEQYRLISCDTSAITQACGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 828 - protein, 302 aa, Artificial Sequence
  Recombinant HIV protein
CVKLTPLCVTLNCTDVTVGGSGGGGSGGCTRPNNNTRKSMRIGPGQTFYATGEIIGDIRQAHCGGSGGGGSGGSTGMKNCSFNITTEIRDKKKKESALFYRLDIVPLDESSDSSSNYSEYRLISCNTSTITQACGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 829 - protein, 298 aa, Artificial Sequence
  Recombinant HIV protein
CVKLTPLCVTLNCSKLNNGGSGGGGSGGCTRPGNNTRKSIRIGPGQAFFATTNIIGDIRQAYCGGSGGGGSGGDGEMKNCSFNATTELWDKKKQVYALFYKLDIVPLDGRNNSSEYRLINCNTSTITQACGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 830 - protein, 298 aa, Artificial Sequence
  Recombinant HIV protein
CVKLTPLCVTLDCSTYNNGGSGGGGSGGCTRPNNNTRKSIRIGPGQSFYATGEIVGNIREAHCGGSGGGGSGGSKEMKICSFNMTTELRDKKRKVNVLFYKLDLVPLTNSSNTTNYRLISCNTSTCTQACGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 831 - protein, 309 aa, Artificial Sequence
  Recombinant HIV protein
CVKLTPLCVTLQCTNVTNGGSGGGGSGGCTRPNNNTRKSIRIGPGQAFYATGDIIGDIRQAHCGGSGGGGSGGRGELKNCSFNMTTELRDKKQKVYSLFYRLDVVQINENQGNRSNNSNKEYRLINCNTSAITQACGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 832 - protein, 301 aa, Artificial Sequence
  Recombinant HIV protein
CVKLTPLCVTLDCKNVTLGGSGGGGSGGCTRPNNNTRKSIRIGPGQTFYATGEIIGDIRQAHCGGSGGGGSGGVKELRNCSFNATTEVRDKKKKEYALFYSLDIVPLKNSSEQYRLISCDTSAITQACGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 833 - protein, 307 aa, Artificial Sequence
  Recombinant HIV protein
CVKLTPLCVTLNCTDVTVGGSGGGGSGGCTRPNNNTRKSMRIGPGQTFYATGEIIGDIRQAHCGGSGGGGSGGSTGMKNCSFNITTEIRDKKKKESALFYRLDIVPLDESSDSSSNYSEYRLISCNTSTITQACGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 834 - protein, 303 aa, Artificial Sequence
  Recombinant HIV protein
CVKLTPLCVTLNCSKLNNGGSGGGGSGGCTRPGNNTRKSIRIGPGQAFFATTNIIGDIRQAYCGGSGGGGSGGDGEMKNCSFNATTELWDKKKQVYALFYKLDIVPLDGRNNSSEYRLINCNTSTITQACGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 835 - protein, 303 aa, Artificial Sequence
  Recombinant HIV protein
CVKLTPLCVTLDCSTYNNGGSGGGGSGGCTRPNNNTRKSIRIGPGQSFYATGEIVGNIREAHCGGSGGGGSGGSKEMKICSFNMTTELRDKKRKVNVLFYKLDLVPLTNSSNTTNYRLISCNTSTCTQACGGSGGGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 836 - protein, 271 aa, Artificial Sequence
  Recombinant HIV protein
AHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRGSGLIRIGHGFDVHAFGGSGGGGSGGVKLTPLCVTLNCINANVTNSSMTNSSMMEGEIKNCSYNMTTELRDKKRKVFSLFYKLDVVPMNENNSEYRLINCNTSCITQGGSGFYATGAITGDIRQAYAGSGAARPSNNTRKSVHIGPC

SEQ ID NO: 837 - protein, 276 aa, Artificial Sequence
  Recombinant HIV protein
AHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRGSGLIRIGHGFDVHAFGGSGGGGSGGGGSGGVKLTPLCVTLNCINANVTNSSMTNSSMMEGEIKNCSYNMTTELRDKKRKVFSLFYKLDVVPMNENNSEYRLINCNTSCITQGGSGFYATGAITGDIRQAYAGSGAARPSNNTRKSVHIGPC

SEQ ID NO: 838 - protein, 268 aa, Artificial Sequence
  Recombinant HIV protein
AHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRGSGLIRIGHGFDVHAFGGSGGGGSGGVKLTPLCVTLHCTNVTSVNTTGDREGLKNCSFNMTTELRDKRQKVYSLFYRLDIVPINENQGSEYRLINCNTSCITQGGSGFYATGDIIGDIRQAHAAGSGAIRPNNNTRKSIRIGPC

SEQ ID NO: 839 - protein, 273 aa, Artificial Sequence
  Recombinant HIV protein
AHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRGSGLIRIGHGFDVHAFGGSGGGGSGGGGSGGVKLTPLCVTLHCTNVTSVNTTGDREGLKNCSFNMTTELRDKRQKVYSLFYRLDIVPINENQGSEYRLINCNTSCITQGGSGFYATGDIIGDIRQAHAAGSGAIRPNNNTRKSIRIGPC

SEQ ID NO: 840 - protein, 271 aa, Artificial Sequence
  Recombinant HIV protein
AHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRGSGLIRIGHGFDVHAFGGSGGGGSGGVKLTPLCVTLNCINANVTNSSMTNSSMMEGEIKNCSYNMTTELRDKKRKVFSCFYKLDVVPMNENNSEYRLINCNTSCITQGGSGFYACGAITGDIRQAYAGSGAARPSNNTRKSVHIGPC

SEQ ID NO: 841 - protein, 276 aa, Artificial Sequence
  Recombinant HIV protein
AHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRGSGLIRIGHGFDVHAFGGSGGGGSGGGGSGGVKLTPLCVTLNCINANVTNSSMTNSSMMEGEIKNCSYNMTTELRDKKRKVFSCFYKLDVVPMNENNSEYRLINCNTSCITQGGSGFYACGAITGDIRQAYAGSGAARPSNNTRKSVHIGPC

SEQ ID NO: 842 - protein, 268 aa, Artificial Sequence
  Recombinant HIV protein
AHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRGSGLIRIGHGFDVHAFGGSGGGGSGGVKLTPLCVTLHCTNVTSVNTTGDREGLKNCSFNMTTELRDKRQKVYCLFYRLDIVPINENQGSEYRLINCNTSCITQGGSGFYCTGDIIGDIRQAHAAGSGAIRPNNNTRKSIRIGPC

SEQ ID NO: 843 - protein, 273 aa, Artificial Sequence
  Recombinant HIV protein
AHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRGSGLIRIGHGFDVHAFGGSGGGGSGGGGSGGVKLTPLCVTLHCTNVTSVNTTGDREGLKNCSFNMTTELRDKRQKVYCLFYRLDIVPINENQGSEYRLINCNTSCITQGGSGFYCTGDIIGDIRQAHAAGSGAIRPNNNTRKSIRIGPC

SEQ ID NO: 844 - protein, 167 aa, Artificial Sequence
  Recombinant HIV protein
CVKLTPLCVTLQCTNVTNGGSGGGGSGGCTRPNNNTRKSIRIGPGQAFYATGDIIGDIRQAHCGGSGGGGSGGRGELKNCSFNMTTELRDKKQKVYSLFYRLDVVQINENQGNRSNNSNKEYRLINCNTSAITQACSGGGGYIPEAPRDGQAYVRKDGEWVLLSTFL

SEQ ID NO: 845 - protein, 159 aa, Artificial Sequence
  Recombinant HIV protein
CVKLTPLCVTLDCKNVTLGGSGGGGSGGCTRPNNNTRKSIRIGPGQTFYATGEIIGDIRQAHCGGSGGGGSGGVKELRNCSFNATTEVRDKKKKEYALFYSLDIVPLKNSSEQYRLISCDTSAITQACSGGGGYIPEAPRDGQAYVRKDGEWVLLSTFL

SEQ ID NO: 846 - protein, 165 aa, Artificial Sequence
  Recombinant HIV protein
CVKLTPLCVTLNCTDVTVGGSGGGGSGGCTRPNNNTRKSMRIGPGQTFYATGEIIGDIRQAHCGGSGGGGSGGSTGMKNCSFNITTEIRDKKKKESALFYRLDIVPLDESSDSSSNYSEYRLISCNTSTITQACSGGGGYIPEAPRDGQAYVRKDGEWVLLSTFL

SEQ ID NO: 847 - protein, 161 aa, Artificial Sequence
  Recombinant HIV protein
CVKLTPLCVTLNCSKLNNGGSGGGGSGGCTRPGNNTRKSIRIGPGQAFFATTNIIGDIRQAYCGGSGGGGSGGDGEMKNCSFNATTELWDKKKQVYALFYKLDIVPLDGRNNSSEYRLINCNTSTITQACSGGGGYIPEAPRDGQAYVRKDGEWVLLSTFL

SEQ ID NO: 848 - protein, 161 aa, Artificial Sequence
  Recombinant HIV protein
CVKLTPLCVTLDCSTYNNGGSGGGGSGGCTRPNNNTRKSIRIGPGQSFYATGEIVGNIREAHCGGSGGGGSGGSKEMKICSFNMTTELRDKKRKVNVLFYKLDLVPLTNSSNTTNYRLISCNTSTCTQACSGGGGYIPEAPRDGQAYVRKDGEWVLLSTFL

SEQ ID NO: 849 - protein, 171 aa, Artificial Sequence
  Recombinant HIV protein
CVKLTPLCVTLQCTNVTNGGSGGGGSGGCTRPNNNTRKSIRIGPGQAFYATGDIIGDIRQAHCGGSGGGGSGGRGELKNCSFNMTTELRDKKQKVYSLFYRLDVVQINENQGNRSNNSNKEYRLINCNTSAITQACGGSGGSGGGYIPEAPRDGQAYVRKDGEWVLLSTFL

SEQ ID NO: 850 - protein, 163 aa, Artificial Sequence
  Recombinant HIV protein
CVKLTPLCVTLDCKNVTLGGSGGGGSGGCTRPNNNTRKSIRIGPGQTFYATGEIIGDIRQAHCGGSGGGGSGGVKELRNCSFNATTEVRDKKKKEYALFYSLDIVPLKNSSEQYRLISCDTSAITQACGGSGGSGGGYIPEAPRDGQAYVRKDGEWVLLSTFL

SEQ ID NO: 851 - protein, 169 aa, Artificial Sequence
  Recombinant HIV protein
CVKLTPLCVTLNCTDVTVGGSGGGGSGGCTRPNNNTRKSMRIGPGQTFYATGEIIGDIRQAHCGGSGGGGSGGSTGMKNCSFNITTEIRDKKKKESALFYRLDIVPLDESSDSSSNYSEYRLISCNTSTITQACGGSGGSGGGYIPEAPRDGQAYVRKDGEWVLLSTFL

SEQ ID NO: 852 - protein, 165 aa, Artificial Sequence
  Recombinant HIV protein
CVKLTPLCVTLNCSKLNNGGSGGGGSGGCTRPGNNTRKSIRIGPGQAFFATTNIIGDIRQAYCGGSGGGGSGGDGEMKNCSFNATTELWDKKKQVYALFYKLDIVPLDGRNNSSEYRLINCNTSTITQACGGSGGSGGGYIPEAPRDGQAYVRKDGEWVLLSTFL

SEQ ID NO: 853 - protein, 165 aa, Artificial Sequence
  Recombinant HIV protein
CVKLTPLCVTLDCSTYNNGGSGGGGSGGCTRPNNNTRKSIRIGPGQSFYATGEIVGNIREAHCGGSGGGGSGGSKEMKICSFNMTTELRDKKRKVNVLFYKLDLVPLTNSSNTTNYRLISCNTSTCTQACGGSGGSGGGYIPEAPRDGQAYVRKDGEWVLLSTFL

SEQ ID NO: 854 - protein, 15 aa, Artificial Sequence
  Recombinant HIV protein
GGSGGGGSGGGGSGG

SEQ ID NO: 855 - protein, 170 aa, Artificial Sequence
  Recombinant HIV protein
MSLIRIGHGFDVHAFGEDRPLIIGGVEVPYHTGFIAHSDGDVALHALTDAILGAAALGDIGKLFPDTDMQYKNADSRGLLREAFRQVQEKGYKIGNVDITIIAQAPKMRPHIDAMRAKIAEDLQCDIEQVNVKATTTEKLGFTGRQEGIACEAVALLIRQEGGSHHHHHH

SEQ ID NO: 856 - protein, 619 aa, Artificial Sequence
  Recombinant HIV protein
AENLWVTVYYGVPVWKEANPTLFCASDAKAYKTEMHNVWATHACVPTDPNPQEMVLENVTEDFNMWKNGMVEQMHQDIISLWDQSLKPCVKLTPLCVTLNCTEVTRSSNGTINNNSTEMKNCSFNVTTDLRDKKKKEHALFYRLDIVPLDETNGTSSEYRLINCNTSTCTQACPKVSFDPIPIHYCAPAGYAILKCKDKKFNGTGPCKNVSTVQCTHGIKPVVSTQLLLNGSIAEGEIIIRSENLTNNAKIIIVQLNVTVEINCTRPNNNTRRSIRIGPGQTFYATGEIIGDIRQAHCNISREKWNRTLQKVEKKLEELFPNKTIHFTSSSGGDLEITTHSFNCMGEFFYCNTSALFNNNNDSTNSNITLPCRIRQFINMWQEVGRCMYAPPIQGVITCKSNVTGLLLTRDGGIINDTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 857 - protein, 630 aa, Artificial Sequence
  Recombinant HIV protein
AENLWVTVYYGVPVWKEASPTLFCASDAKAYDTEVHNVWATYACVPTDPNPQELVMENVTENFNMWKNDMVEQMHQDIISLWDEGLKPCVKLTPLCVTLHCSSNVTSNSNVTSNSTDASKVNKDIIGQMKNCSFNITTEVRDKNKKAYALFYRLDIVPLTADNSSGEYRLINCNTSTCTQACPKVSFDPIPLHYCAPAGYAILKCNDKTFNGTGPCKNVSTVQCTHGIKPVVSTQLLLNGSIAEDKTIIRSENLTNNAKIIIVQLNEPVEINCTRPNNNTRQSIRIGPGQTFYATGEIIGDIRQAHCNISGDRWNKTLESVKERLQKQFPNKTILFAPSSGGDLEITTHSFNCRGEFFYCNTSKLFNTTGLSDNATLTIPCRIKQIINMWQEVGRCMYAPPIKGIITCRSNITGLLLTRDGGTNNTNNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 858 - protein, 628 aa, Artificial Sequence
  Recombinant HIV protein
AENLWVTVYYGVPVWKEATTTLFCASDAKAYETEVHNVWATHACVPTDLNPQEVVLENVTENFNMWKNNMVEQMHEDIISLWDQSLKPCVKLTPLCVTLNCTDNINTTQTNSSIMEKGEIKNCSFNVTTNIRDKMQKEYALFYKLDVISIKNDNSSYRLIDCNTSVCTQACPKVSFEPIPIHYCAPAGFAILKCNDKKFNGTGLCTNVSTVQCTHGIRPVVSTQLLLNGSLAEEEVVIRSENLTDNAKTIIVQLKEAVEINCTRPNNNTRKSINIGPGRAFVATGAIIGDIRQAHCNISRTKWNDTLKQVVTKLREKFGNKTIVFNQSSGGDAELVMHSFNCGGEFFYCNSTQLFNSTWSVNSTGNDTTEEPNITFPCRIKQIINMWQEVGKCMYNPPIKGIISCRSNITGLLLTRDGGNNNNTNTTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 859 - protein, 643 aa, Artificial Sequence
  Recombinant HIV protein
AENLWVTVYYGVPVWKETTTTLFCASDARAYDTEVHNVWATHACVPTDPNPQEVVLGNVTENFNMWKNNMVEQMHEDIISLWDQSLKPCVRLTPLCVTLNCIDYYGNTTNSNNSSETMMEKGEIKNCSFNITTRLKDKMQKEYALFYKYDIVPIDNRVGNDTSNATSYRLTSCNTSVCTQACPKVSFEPIPIHYCAPAGFAILKCNDKKFNGTGPCKNVSTVQCTHGIKPVVSTQLLLNGSLAEEEVMIRSENFTDNAKTIIVQLNETVEINCTRPNNNTRKSIHMGPGKVFYTTGEIIGDIRQAHCNINRAKWNNTLIKIVEKLRVKFNKTISFKQSSGGDPEIEMHSFNCGGEFFYCNTTQLFNSTWFNNATLNVNSNVTEGSENITLPCRIRQIVNMWQEVGKCMYAPPIQGQIRCSSNITGLLLTRDGGGSNSSNTSEEVFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 860 - protein, 635 aa, Artificial Sequence
  Recombinant HIV protein
AENLWVTVYYGVPVWKEATTTLFCASDAKAHHAEAHNVWATHACVPTDPNPQEVILENVTEKFNMWKNNMVDQMHEDIISLWDQSLKPCVKLTPLCVTLNCTNATYTNSDSKNSTSNSSLEDSGKGDMNCSFDVTTSIDKKKKTEYAIFDKLDVMNIGNGRYTLLNCNTSVCTQACPKMSFEPIPIHYCTPAGYAILKCNDNKFNGTGPCTNVSTIQCTHGIKPVVSTQLLLNGSLAEGGEVIIRSENLTDNAKTIIVQLKEPVEINCTRPNNNTRKSIHMGPGAAFYARGEVIGDIRQAHCNISRGRWNDTLKQIAKKLREQFNKTISFNQSSGGDLEIVMHTFNCGGEFFYCNTTQLFNSTWNENDTTWNNTAGSNNNETITLPCRIKQIINRWQEVGKCMYAPPISGPINCLSNITGLLLTRDGGDNNNTIETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 861 - protein, 635 aa, Artificial Sequence
  Recombinant HIV protein
AENLWVTVYYGVPVWKEATTTLFCASEAKAYDTEVHNVWATHACVPTDPNPQEVELGNVTENFNMWKNDMVEQMHEDIISLWDQSLKPCVRLTPLCVTLDCTDLNNTTNTNNTTNTNSSKIEGGEMKNCSFNITTNRGDKRQKEYALLYRTDIVSIENTSSSYRLISCNTSVCTQACPKVTFEPIPIHYCAPAGFAILKCNEDKFNGTGPCKNVSTVQCTHGIRPTVSTQLLLNGSLAKEEVIIRSANLSDNAKIIIVQLKDPVEINCTRPNNNTRKSINLGPGRAFYATGDIIGDIRQAHCNISRAKWNDTLREIAKKLAEQFNNRTIVFNQSSGGDPEIVMHSFNCAGEFFYCDTSQLFNSTWNSNSTWNDTNNNNSTEKIILSCRIRQIINRWQEVGKCMYAPPISGPIKCSSNITGLLLARDGGNETNVTETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 862 - protein, 639 aa, Artificial Sequence
  Recombinant HIV protein
AENLWVTVYYGVPVWKEANTTLFCASDAKAYVTEVHNAWATRACVPTDPNPQEVALENVTENFNMWKNNMVEQMHEDIISLWDESLKPCVKLTPLCVTLKCINYNNTNNGSNANNTSIEGREEIKNCSFNITTTIRDKVQKEEALFYRLDLVPIDNDTYTLINCNTSVCTQACPKVSFEPIPIHFCTPAGFAILKCRDKKFNGTGSCKNVSTVQCTHGIRPVVSTQLLLNGSLAEEEVVIRSENFTDNVKTIIVQLNESVVINCTRPNNNTRKGIHIGPGRAFYTTGQIIGDIRQAHCNLSRAQWNKTLEQIVEKLGEQFRNKNISFMQHSGGDPEIVTHTFNCGGEFFYCNSTQLFNSTWTRPPNGTWRSNGTWNSTEGTNDTITLPCRIKQIINMWQGVGKCMYAPPISGQIRCTSNITGLLLTRDGGENRTDNGTEIFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 863 - protein, 641 aa, Artificial Sequence
  Recombinant HIV protein
AENLWVTVYYGVPVWKEAKTTLFCASDAKAYEKEVHNVWATHACVPTDPNPQEMVLENVTENFNMWENDVVDQMHEDVISLWDQSLKPCVKLTPLCVTLNCSKAKNITEEVIKNNTYKEDIRNCSFNATTEVKDKKQKVHALFYRLDIVPLNKRNSSESEEENSSGYYRLINCNTSACTQACPKVTFDPIPIHYCTPAGYAILKCNEETFNGTGPCHNVSTVQCTHGIKPVVSTQLLLNGSLAEGEIIIRSKNLTDNAKTIIVHLNQSVEIVCTRPNENRRKSIRIGPGQAFYATGDIIGDIRQARCNISEEKWNETLQRVGRKLAEHFPNKTIKFKSSSGGDLEITTHSFNCRGEFFYCNTSGLFNGTYMPTYMPNSTNSNSSSNITIPCRIKQVINMWQEVGRCMYAPPIEGEITCKSNITGLLLVRDGGNGNDTNKTEIFRPEGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 864 - protein, 639 aa, Artificial Sequence
  Recombinant HIV protein
AENLWVTVYYGVPVWKEARTTLFCASDAKAYETEVHNVWATHACVPTDPNPQEMVLGNVTENFNMWKNDMVDQMHEDVISLWAQSLKPCVKLTPLCVTLECTQVNATQGNTTQVNVTQVNGDEMKNCSFNTTTEIRDKKQKAYALFYRLDLVPLERENRGDSNSASKYILINCNTSACTQACPKVNFDPIPIHYCTPAGYAILKCNNKTFNGTGSCNNVSTVQCTHGIKPVVSTQLLLNGSLAEEEIIIRSENLTDNVKTIIVHLDQSVEIVCTRPNNNTRKSIRIGPGQTFYATGDIIGNIREAHCNISEKKWHEMLRRVSEKLAEHFPNKTIKFTSSSGGDLEITTHSFNCRGEFFYCNTSGLFNSTYMPNGTYMPNGTNNSNSTIILPCRIKQIINMWQEVGRCMYAPPIAGNITCNSNITGLLLVRDGGKNNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 865 - protein, 653 aa, Artificial Sequence
  Recombinant HIV protein
AENLWVTVYYGVPVWREAKATLFCASDAKAYEREVHNVWATHACVPTDPDPQEMALVNVTENFNMWKNDMVDQMHEDIINLWDQSLKPCVKLTPLCVTLNCTDAKFNSTQSDNGTSTVNVSTSNEMKNCSFNITTEIRDKKKKESAIFYKLDVVPLDGNGNNSGNYSEYRLINCNTSTCTQACPKVSFDPIPIHYCAPAGYAILKCNNKTFNGSGPCNKVSTVQCTHGIKPVVSTQLLLNGSLAEEEIVIRSENITDNVKTIIVHLNESVEIECTRPGNNTRKSMRIGPGQIFYATGDIIGDIRQAYCNINESKWNETLQKVGKKLREHFSNKTIEFQPPSPGGDLEITTHSFNCGGEFFYCNTSRLFNGKFNGTMGNYTINSTITLPCRIKQIINMWQGVGRCMYAPPIAGNITCRSNITGILLTRDGSETNDGNTNETGTKTFKSNETETEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 866 - protein, 626 aa, Artificial Sequence
  Recombinant HIV protein
AENLWVTVYYGVPVWKEAKTTLFCASDAKAHEREVHNVWATYACVPTDPNPQEIVLKNVTENFNMWENDMVDQMQEDVISLWDQSLKPCIKLTPLCVTLECTNVNIINGTIHNETYESMKNCSFNTTTELKDKKQSVYALFYRLDIVPLNNSNEYYRLINCNTSACKQACPKVTFDPIPIHYCAPAGYAILKCNDKTFSGTGPCHNVSTVQCTHGIKPVVSTQLLLNGSLAEGEIIIRSKKLDDNANTIIVHLDEPVKIECTRPNNNTRKSIRIGPGQTFYATGEIIGNIRQAHCDISEDQWNETLQRVGKKLAELFPNKTITFNSSSGGDLEITTHSFNCRGEFFYCNTSSLFKGTYRPNGTSNSTSGSIITLPCYIKQVINLWQEVGRCIYAPPIEGNITCISNITGLLLVRDGGNHEEANTTETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 867 - protein, 642 aa, Artificial Sequence
  Recombinant HIV protein
AENLWVTVYYGVPVWKDAETTLFCASDAKAYDKEVHNVWATHACVPTDPNPQEVFLENVTEEFNMWKNNMVEQMHTDIISLWDQSLQPCVQLTPLCVTLNCTDYKGNYTNYNYTKNNGTGHNITSDMEGEIKDCSFNVTTELRDKRQKVHSLFYRLDIVQINSSQTNSSEYRLINCNTSACTQACPKISFNPIPIHYCAPAGFAILKCNDKKFHGTGPCKNVSSVQCTHGIKPIVSTQLLLNGSLAEEKVAIRSENITNNAKNILVQLKSPVNITCVRPNNNTRTSVRIGPGQTFYATGAITGDIRQAHCNVSKAKWNETLRQVAVQLKTYFNKTIIFNSSAGGDLEITTHSFNCGGEFFYCNTSGLFNSTWNDTSNHNTSGTESNANITLQCRIKQIINMWQRAGQCIYAPPIQGIIKCESNITGLILTRDGGDNNNTTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 868 - protein, 625 aa, Artificial Sequence
  Recombinant HIV protein
AENLWVTVYYGVPVWKDAETTLFCATDAKAYKTEMHNVWATHACVPTDPNPQEIMMENVTEDFNMWKNNMVEQMHTDIISLWDQSLKPCVKLTPLCVTLNCGKVKNDTRDELRNCSYNMTTELRDRRQKVFSLFYRLDIVEIENNRTNNRTNNTEYRLINCNTSACTQACPKVTFEPIPIHYCAPAGYAILKCNNESFNGTGPCKNVSTVQCTHGIKPVVSTQLLLNGSLAKDQVMIRSENITNNAKNIIVQFKGSVQINCTRPNNNTRKSVHIGPGQAFYATDIIGDIRQAHCNVSGTEWNKTLGEVVKQLRTYWNRTIIFTNSSGGDLEITTHSFNCAGEFFYCNTSGLFNSTWYTNGSTQGVTNDTIQLQCRIKQIINMWQRVGQCIYAPPIPGVINCSSSITGMILTRDGGNNNNGANGNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 869 - protein, 648 aa, Artificial Sequence
  Recombinant HIV protein
AENLWVTVYYGVPVWKDAETTLFCASDAKAYDKEKHNVWATHACVPTDPNPQEIHLENVTEEFNMWKNNMVEQMHTDIISLWDQSLKPCVKLTPLCVTLNCSHNITRLNTSSPNITGNDTNSSPNITENDTENERKNCSFNITTELRDKSKQVYSLFYRLDIVPIDGSDNSSDNSNNYRLINCNTSACTQACPKVSFEPIPIHYCAPAGFAILKCKDGNFSGKGPCKNVSTVQCTHGIKPVVSTQLLLNGSLAEEKVKIRSENISDNTKNIIVQLVQPVKINCTRPDNNTRKSIHIGPGQAFFATGAIIGKIRQAHCNVSKTEWNKALKQVVEQLRRDFGNKTIIFKNSSGGDLEITTHSFNCGGEFFYCNTSGLFNSTWLSNSTNSTDNTGTNDTITLQCRIKQIINMWQRVGQCMYAPPIPGVIRCESNITGLMLTRDGGNNATNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 870 - protein, 640 aa, Artificial Sequence
  Recombinant HIV protein
AENLWVTVYYGVPVWKEATTTLFCASDAKSYETEAHNVWATHACVPTDPNPQEIPLVNVTENFNMWKNNMVEQMQTDIISLWDQSLQPCVKLTPLCVTLNCSDIDNNRNNSTVTNSTVTNSTADMKNCSFRVPTAIRDRKQKVYSLFYRLDIVQIDKKKNDSNNSNITQYRLINCNTSACTQACPKISFEPIPIHYCAPAGFAILKCRDKEFNGTGPCKNVSTVQCTHGIRPVVSTQLLLNGSLAEGKIMIRSENITNNGKNIIVQFNETVKINCTRLNNNTRKSISIGPGQAFYATGDIIGDIRQAHCNVSRAEWNETLRKVAEELRTYFKNKTIHFNKSAGGDLEVTTHSFNCGGEFFYCNTSKLFDSSWPKTNSTVQESNSTDNITLQCRIKQIINMWQRVGQCMYAPPIAGVIRCESNITGLILTRDGGSNTNASETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 871 - protein, 622 aa, Artificial Sequence
  Recombinant HIV protein
AENLWVTVYYGVPVWKEAKTTLFCASDAKAYETEVHNIWATHACVPTDPNPQEMELPNVTENFNMWKNDMVDQMHEDIISLWDQSLKPCVKLTPLCVTLNCTITNSSSIMTNCTFNTTTELKDKKRKASASFYRLDIVPLNGDSNGSSSGSYRLINCNTSTCTQACPKVSFDPIPIHYCAPAGYAILKCNDETFNGTGPCHNVSTVQCTHGIKPVVSTQLLLNGSLSEGEIIIRSENLTDNVKTIIVHLNKSIEINCIRTGNNTRRSIRIGPGQTFYATGDIIGDIRKAYCNISKHIWNKTLEEVATKLGAHFINKTIKFAPPSGGDLEITTHSFNCRGEFFYCNTTQLFNNISIGRFNTSIENDTNIILPCRIKQIINMWQEVGRCMYAPPIEGNITCRSNITGILLTRDGGNGGADNSTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 872 - protein, 634 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 873 - protein, 647 aa, Artificial Sequence
  Recombinant HIV protein
AENLWVTVYYGVPVWREAKTTLFCASDAKAYEKEVHNVWATHACVPTDPNPQEIDLNVTENFNMWKNDMVEQMHEDVISLWDQSLKPCVKLTPICVTLECTDANITCNSTTSSNNCTSYEINKEDMGEIKNCSFNTTTELIDKQKKVHALFYRLDIVSLEKDNSSKKNDSNEYYRLINCNTSACTQACPKVTFDPIPIHYCAPAGYAILKCKNKTFNGTGPCNNVSTVQCTHGIKPVVSTQLLLNGSLAEEEIIIRSENLTNNAKIIIVHLNQAVEIVCTRPGNNTRKSIRIGPGQTFYATGDIIGDIRQAHCNISEAKWNKTLREVSKKLAEHFPNKTIIFNSSSGGDLEITTHSFNCGGEFFYCNTSSLFNSTFNSTYMTNDTDMNSNSTISIPCRIKQIINMWQEVGRCMYAPPIAGNITCKSNITGLLLVRDGGNSNDTNEPEIFRPQGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 874 - protein, 626 aa, Artificial Sequence
  Recombinant HIV protein
AENLWVTVYYGVPVWKEAKTTLFCASDAKAYETEVHNVWATHACVPTDPNPQELVLENVTENFNMWRNDMVDQMHEDVISLWDQSLKPCVKLTPLCVTLECRNATSKMVNDTRNVEEMKNCSFNTTTELRDRKQTVYASFYKLDIVPLNENKSTSSENYRLINCNTSACTQACPKVNFDPIPIHYCTPAGYAILKCNNKTFNGTGPCSNVSTVQCTHGIKPVVSTQLLLNGSLAEEGIIIRSENLTDNVKTIIVHLEEPVEIVCTRPNNNTRKSVRIGPGQTFYATGEIIGDIRQAHCNISEAKWNETLQNVTKKLKEHFPNKTIIFNSSSGGDLEITTHSFNCRGEFFYCNTSKLFNGIYNGTQSNSSNSNSTIIIPCKIKQIVNMWQKVGRCMYAPPIAGNITCTSNITGLLLVRDGGPDNVTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 875 - protein, 640 aa, Artificial Sequence
  Recombinant HIV protein
AENLWVTVYYGVPVWKEASTTLFCASDAKAYEAEAHNIWATHACVPTDPNPQEIEIKNVTENFNMWKNDMVEQMHEDIISLWDQSLQPCVKLTPLCVTLNCSDLDNSNKGNATNTTVASEAGMNTTVAPEAGMKNCSFNITTEVKDKKKLVYAHFYNLDVVQLDGNTNSYRLIHCNTSACTRACPKITFEPIPIHYCAPAGFAILRCNNKMFNGTGPCNNVSTVQCTHGIKPVVSTQLLLNGSLAEEGVIIRSENLTDNTKTIIVQLNESVIINCTRPNNNTRQGVHIGPGQALFTNRVIGNIRLAYCNISRKDWNKTLRQVAEKLGNLYNKTKIIFEPSSGGDPEIVTHSFNCGGEFFYCSTSKLFNETIDLNNTYNASIENNTIITLPCRIKQIINMWQGVGKCIYAPPIEGLIKCTSNITGILLTRDGGRDNSSSNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 876 - protein, 625 aa, Artificial Sequence
  Recombinant HIV protein
AENLWVTVYYGVPVWKDAVTTLFCASDAKAYDTEVHNVWATHACVPTDPNPQEKQLENVTEDFNMWKNDMVDQMHADIISLWDQSLKPCVQLTPLCVTLHCRNTNASSNTSGDMQGEEMKNCSFNVTAELRDKRKNEYALFYRQDVVQINETDNSTYRLINCNTSTCTQACPKVTFEPIPIHYCAPAGYAILKCNEKGYKGIGKCRNVSTVQCTHGIKPVVSTQLLLNGSLAEGEVVIRTENITNNAGTIIVQLNETVKINCSRPNNNTRRSVRIGPGQTFYATDIIGDIRQAHCNVSSTKWNRTLHQVATQLKKHFNTTTITFAEPSGGDLEIITHSFNCGGEFFYCNTSRLFNSTWGSNNTWDNSTEQNITLRCKIKQIINMWQRVGQCMYAPPIRGEIRCESNITGLLLTRDGGGNSSSANETFRPTGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 877 - protein, 635 aa, Artificial Sequence
  Recombinant HIV protein
AENLWVTVYYGVPVWRDADTTLFCASDAKAYEKEVHNVWATHACVPTDPNPQEIHLKNVTEEFNMWKNNMVEQMHEDIISLWDQSLKPCVKLTPLCVTLDCIEIRNNTDNITVDSNMKGEITNCSFNMTTELRDKKQKVSAFFYRQDVVPVNSNQDNSSYRLINCNTSACTQACPKVTFEPIPIHYCAPAGFAILKCNDKKFNGTGPCKNVSTVQCTHGIKPVVSTQLLLNGSLAEEEVAIRSENISNNGKTIIVQLVKPVNITCIRPNNNTRKSVRIGPGQTFYATGEIIGNIRQAHCVVNKTEWNETLYQVVTRLREYFKNTTITFTNHSGGDLEVTTHSFNCGGEFFYCNTSELFNSNWTNTNNNTNNASSEANGNITLTCKIKQIINMWQRVGQCMYAPPIQGIIRCESNITGLLLTRDGGFRNDTNETYEAFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 878 - protein, 621 aa, Artificial Sequence
  Recombinant HIV protein
AENLWVTVYYGVPVWKEATTTLFCASDAKAYKAEAHNIWATHACVPTDPNPQEIELKNVTENFNMWRNNMVEQMHEDIISLWDQSLKPCVKLTPLCVTLNCTNVTSSTNGTVGNTEDMKNCSFNITTIVRDKKKQEYALFYRLDIVEINPNDTSYRLINCNTSACTQACPKMSFEPIPIHYCAPAGFAILKCNDKKFKGTGPCSNVSTVQCTHGIRPVVSTQLLLNGSLAEEEIMIRSEDFTNNVKNIIVQFNKSVEIVCIRPGNNTKRSIHFGPGQALYAYSIIGDIRNANCTINKTSWHDTLQKVEKELEKIYNKKINFEPSSGGDLEITTHSFNCGGEFFYCNTSKLFNSTWANSTWDNSNITNITIPCRIKQIINMWQGVGRCMYAPPIAGEIRCTSNITGLLLTRDGGSNNTNETETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 879 - protein, 629 aa, Artificial Sequence
  Recombinant HIV protein
AENLWVTVYYGVPVWKEATTTLFCASDAKAYDKEVHNVWATHACVPTDPNPQEMVLGNVTENFNMWKNEMVNQMHEDVISLWDQSLKPCVKLTPLCVTLECSNVTYNESMKEVKNCSFNLTTELRDKKQKVHALFYRLDIVPLNDTEKKNSSRPYRLINCNTSACTQACPKVTFDPIPIHYCTPAGYAILKCNDKKFNGTGPCHKVSTVQCTHGIKPVVSTQLLLNGSLAEGEIIIRSENLTNNAKTIIVHLNQSVEIVCARPSNNTRTSIRIGPGQTFYATGAITGDIRQAHCNISKDKWNETLQRVGEKLAEHFPNKTIKFNSSSGGDLEITTHSFNCRGEFFYCNTSGLFNGTFNGTYVSPNSTDSNSSSIITIPCRIKQIINMWQEVGRCMYAPPIAGNITCKSNITGLLLVRDGGTGSESNKTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 880 - protein, 636 aa, Artificial Sequence
  Recombinant HIV protein
AENLWVTVYYGVPVWKEAKTTLFCASDAKGYDKEVHNVWATHACVPTDPNPQEMPLENVTENFNMWENDMVNQMHEDVISLWDESLKPCVKLTPLCVTLNCTDVNKNVSSSDTDNYKETMKERKNCTFNMTTELRDKNQKKYALFYKLDIVPLDDNDNASYRLINCNTSTCTQACPKVSFDPIPIHYCAPAGYAILKCKNKTFNGIGPCNKVSTVQCTHGIKPVVSTQLLLNGSLAEEDIVIRSENITDNAKTIIVHLNESVEIVCIRPNNNTRKSIRIGPGQTFYATGDIVGDIRQAYCNISEGKWNKTLQRVSEKLAEHFPNSTINFNSSSGGDLEITTHSFNCGGEFFYCNTSGLFNGTYMNNDTKSNDTKSNSSSIITIPCRIKQIINMWQEVGRCVYAPPIAGNITCKSNITGILLTRDGGRGEEVKNDTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 881 - protein, 630 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 882 - protein, 621 aa, Artificial Sequence
  Recombinant HIV protein
AENLWVTVYYGVPVWKEAKTTLFCASDAKAYEKEVHNVWATHACVPTDPNPQEIVLGNVTEDFNMWKNDMVDQMHEDVISLWDQSLKPCVKLTPLCVTLDCANVTSNITNGEEIKNCSFNATTDVRDKKKTVYSLFYRLDIVQLDGRSNTSNYRLINCNTSTCTQACPKVSFDPIPIHYCAPAGYAILKCNNKTFNGKGPCHNISTVQCTHGIKPVVSTQLLLNGSLAEEEIIIRSENLTNNVKTIIVHLNKPVKIVCTRPGNNTRKSIRIGPGQTFYATGEIIGNIRQAHCNISKEEWNKTLQGVGEKLAEHFPNKTIEFTSPSGGDLEITTHSFNCRGEFFYCNTSDLFNGIYNGTYIPKGNLNSTITIQCKIKQFINMWQEVGRCMYAPPIQGNITCESNITGLLLVRDGGNSNSTEEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 883 - protein, 650 aa, Artificial Sequence
  Recombinant HIV protein
AENLWVTVYYGVPVWREAETTLFCASDAKAVSPEAHNIWATHACVPTDPNPQEMQLENVTEEFNIWNNSMVEQMHKDIIDLWDQSLKPCVQLTPLCVTLNCSSVSNSSSSNSTYNITVSQSMEGEIKNCSFNMTTELRDKKKKVYALFYRLDVIEINDTSSSNSDNSSSTQYNKYRLINCNTSACTQACPKVSFEPIPLHLCAPAGFAILKCNDKKFNGKGTCNNVSTVQCTHGIKPVVSTQMLLNGSLAGEEIGIRSENISNNAKTIMIQLKEPVQINCTRPNNNTRKSIHMGPGQAFYATDAVIGDIRQAYCNVSKGTWNKTLQAVAKQLYKHFNKTIIFNSSSGGDLEITTHSFNCGGEFFYCNTSRLFNSTWNNSSIWDNSTGDYNSTKDNETITLPCRIKQIINMWQKVGQCMYAPPIKGIIRCDSNITGLLLTRDGGINNSTSETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 884 - protein, 628 aa, Artificial Sequence
  Recombinant HIV protein
AENLWVTVYYGVPVWRDAETTLFCASDAKAYDTEAHNVWATHACVPTDPSPQEIPLINVTENFNMWKNKMVEQMQEDVISLWDQSLKPCVKLTPLCVTLNCTKATHTGDNSTSVNLTEIVEMQNCSYNMTTELRDRSRKEYSLFYKLDIVLVNESNSNSSQYRLINCDTSTCTQACPKVSFEPIPIHYCAPAGFAILKCRDKQFNGTGPCSNVSTVQCTHGIKPVVSTQLLLNGSLAEGEVAIRSENFTNNAKTIIVQLTKPVKINCIRPGNNTRRSHRIGPGQTFFATGAIIGDIRQAHCNVSTTEWNNTLSQVVKQLKRYFNNKTIIFTNHSGGDLEITTHTFNCGGEFFYCNTSGLFNSTWWNNNNSSNNITTLQCRIKQIVNLWQRVGKCMYNPPIQGVIRCESNITGLLLTRDGGLNDSSTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 885 - protein, 631 aa, Artificial Sequence
  Recombinant HIV protein
AENLWVTVYYGVPVWREADTTLFCASDAKAYSTEVHNVWATHACVPTDPDPQEILLKNVTEDFNMWKNNMVEQMHADIINLWDQSLKPCVKLTPLCVTMQCTDMTNISIKLASIANTSIAEETQGEIKNCSFNVTELRNKRKKEYAFFYKQDIVQINNNESMLISCNTSTCTQACPKVSFEPIPIHFCAPAGFAILKCNDKKFNGTGPCENVSTVQCTHGIKPVVSTQLLLNGSLAEEEVVIRSENITNNAKTIIVQLDKPVNITCVRPNNNTIKSVRIGPGQAFYTAGQVIGDIRKAYCEVNRTEWKSALNQVASKLRENFQNASTIKFNEHSGGDIEITTHMFNCKGEFFYCNTSSLFNYTFSNSTEDNNPSNATITLQCRIRQVVNMWQRVGLCMYAPPIKGKLRCESNITGLLLTRDGGNNNNNATETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 886 - protein, 627 aa, Artificial Sequence
  Recombinant HIV protein
AENLWVTVYYGVPVWKEAKTTLFCASDAKSYRTEAHNIWATHACVPTDPNPQELELENVTENFNMWKNDMVNQMHEDIISLWDQSLKPCVKLTPLCVTLNCQEMNSSTKTNSSISNEDKRMNCSFNVTTVVRDRKKQVAALFYRLDLVAVDNDNSTNYRLINCNTSACTQACPKVSFEPIPIHYCAPAGFAILKCRDKQFNGTGPCTNVSTVQCTHGIRPVVSTQLLLNGSLAEEEIMIRSENISNNAYNIIVQLNESVAIDCTRPYNNTRQSIHIGPGQAVYATDARKIVGDIRQAYCTIDGTEWKKMLQRVAEKLGSLINKPTIKFKPSAGGDAEITTHSFNCGGEFFYCNTSNLFNYTWNNSTGLGNITRNITLPCRIKQIINMWQGVGKCMYAPPIEGQIKCSSNITGLILTRDGGNTSDDHETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 887 - protein, 635 aa, Artificial Sequence
  Recombinant HIV protein
AENLWVTVYYGVPVWKEAKTTLFCASDAKAYSKEVHNVWATHACVPTDPDPQELFLENVTENFNMWKNDMVDQMHEDVISLWDQSLKPCVKLTPICVTLQCVDATIYNGTIKDSSTNYTLNSTEELKNCSFNMTTELRDKTRKVYALFYRLDVEPLNNDNNSTKYRLINCNTSACTQACPKVSFDPIPIHYCAPAGYAILKCNNETFNGTGPCNKVSTVQCTHGIRPVISTQLLLNGSLAEKDIIIRSENLTDNAKTIIVQLNESVEIVCERPNNNTRKSIRIGPGQTFYATGDIIGDIRQAHCNISEKAWNNTLHRVSEKLKEHFPNRTIQFNSSSGGDLEITMHSFNCRGEFFYCNTSILFNSTYNTNGTYWHKGRNDSNITLPCKIKQFINMWQEVGRCMYAPPIAGKITCVSNITGLLLTRDGGKGNNETETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 888 - protein, 622 aa, Artificial Sequence; identical to SEQ ID NO: 765
  Recombinant HIV protein

SEQ ID NO: 889 - protein, 628 aa, Artificial Sequence
  Recombinant HIV protein
AENLWVTVYYGVPVWKETTTTLFCASDAKSYKEEAHNVWATHACVPTDPNPQEIFLGNVTENFNMWKNDMVDQMHEDIISLWDQSLKPCVKLTPLCVTLNCTNINATISNATMGEMKNCSFNITTELRDKKKQEYALFYKLDVVQIDDGANGTNPKYRLINCNTSACTQACPKVTFEPIPIHYCAPAGFAILKCNDKKFNGMGPCNNVSTVQCTHGIKPVVSTQLLLNGSLAEEEVIIRSENLTNNVKNIIVQLNESVTLTCVRPNNNTRKSIRIGPGQTFYATNIIGDIRQAHCNINGTNWTKTLQRVANKLIDLLNLTQINFEPALGGDPEITTHTFNCGGEFFYCNTTNLFNATKWFNRSIEESANANDTSENSTLTLPCRIKQIINMWQGVGKCMYAPPIAGQIKCSSNITGLLLTRDGNNSHETFRPGGGDMGDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 890 - protein, 617 aa, Artificial Sequence
  Recombinant HIV protein
AENLWVTVYYGVPVWKEATTTLFCASDAKAYIKEAHNIWATHACVPTDPNPQEIALENVTEKFNMWKNGMVDQMHEDIISLWDESLKPCVKLTPLCVTLNCTNATNDKVSSELEMKNCSFYITTEIRDRRKQEYALFYRSDVVQINGNNISYRLINCNTSACKQACPKVNFEPIPIHYCAPAGYAILKCNGENFNGTGLCENVSTVQCTHGIRPVVSTQLLLNGSLAEKEIVIRSENITNNAKTIIVQLNETVIINCTRPSNNTRKSIRIGPGQTFYATGDITGDIRQAHCNISATKWINTLQQVANKLRDHFNKTIEFQPSSGGDPEITEHTFNCGGEFFYCNTTNLFNWTFNSISNNINTSTNEITIQCRIKQIINRWQGVGKCMYAPPTAGSINCLSNITGLLLTRDGGNTSEEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 891 - protein, 630 aa, Artificial Sequence
  Recombinant HIV protein
AENLWVTVYYGVPVWRDAETTLFCASDAKGYETEKHNVWATHACVPTDPNPQEIHLENVTEEFNMWKNNMVDQMHTDIISLWDQSLKPCVKLTPLCVTLQCSDVTSNGTNSNVTNREEMKNCSFNVTTEIRDKKQKVYSLFYRLDIVQISNSSNSSEYILINCNTSTCTQACPKISFEPIPIHYCAPAGFAILKCKDEEFDGTGPCKNVSTVQCTHGIKPVVSTQLLLNGSLAEKGVKVRSENITNNAKNIIIQLSKPVEINCIRPNNNTRKSIRIGPGQSFYATGDIIEDIREAHCNVSQTEWNNTLHQVAEQLQKYFNNKTIIFNGSSGGDLEITTHSFNCGGEFFYCNTSGLFNSSWNINGNRESNKTQSNGTITLPCRIKQIINMWQRAGQCIYAPPIQGAIKCVSNITGLILTRDGGNNNNSSNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 892 - protein, 635 aa, Artificial Sequence
  Recombinant HIV protein
AENLWVTVYYGVPVWKDAETTLFCASDAKAHDTEKHNVWATHACVPTDPNPQEIHLENVTENFNMWKNNMVDQMHTDIISLWDQSLKPCVQLTPLCVTLNCNHNVTTNNNTNITSEMREEIRNCSFNVTTVQRDKKQKVYSLFYRLDIVQMNEGNNSSNNSANEYRLINCNTSACTQACPKVSFQPIPIHYCAPAGFAILKCRDKEFNGTGVCKNVSTVQCTHGIKPVVSTQLLLNGSLAEEKVMIRTENITDNAKTIIVQLNKTVTINCTRPGNNTRKSIHIGPGQAFYATGDIIGGIRQAHCNVSRKDWNDTLQRVVEQLGNHFNKTIIFDKPSGGDIEITTHSFNCGGEFFYCNTSGLFNSTWKFNGTWNSTDLESNNTVITLPCRIKQIINMWQRVGQCMYAPPIKGVIRCESSITGLLLTRDGGENNSTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 893 - protein, 639 aa, Artificial Sequence
  Recombinant HIV protein
AENLWVTVYYGVPVWREATTTLFCASDAKSYEKEAHNVWATHACVPTDPNPQEIHMENVTEEFNMWKNSMVEQMHTDIISLWDQSLKPCVKLTPLCVTLQCSDVNVTTNGTANNTVTDNSREEIKNCSFNMTTELRDKERKVHSLFYRLDIVQIDKNNKNNGYRLINCNTSACTQACPKVSFEPIPIHYCAPAGFAILKCKDKEFNGKGQCKNVSTVQCTHGIKPVVSTQLLINGSLAEKEVIIRSENITNNAKTIIVQLAKPVNITCIRPNNNTRKSVRIGPGQAFYTSDIIGNIRQAYCNVSGTEWNDALKQVAIQLGKHFNRTIIFANASGGDLEVTTHSVNCGGEFFYCNTSGLFSSTWNVTYNNNTWNATQVSNSTEPNGTIVIPCRIKQIINMWQRTGQCMYAPPIPGKIQCISNITGLLLTRDGGDTSSMNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 894 - protein, 630 aa, Artificial Sequence
  Recombinant HIV protein
AENLWVTVYYGVPVWKDAKTTLFCASDAKAYEREVHNVWATHACVPTDPNPQEIYLENVTEEFNMWKNDMVDQMHEDIISLWDQSLQPCVRLTPICVMLNCTDVIHNGTQDPNNITDTDMRNCSFNASTEIRGKKHRTYALFYKLDIVSLNNGINNSEYRLINCNTSACTQACPKVTFDPIPIHYCAPAGYAILKCNNKTFNGTGPCNNVSTVQCTHGIKPVVSTQLLLNGSLAEGEIIIRSKNLTDNAKTIIVQLDSPVKINCTRPNNNTRKSIRIGPGQAFFATGEIIGKIRQAYCNVSRTDWNTTLQKVAIQLRKHLNKSTIEFAKHSGGDLEITTHSFNCGGEFFYCNTSSLFNSTWDNSSITQNYTESNETITLQCRIKQIVNAWQRVEQCIYAPPIQGVIRCDSNITGLLLTRDGGGNNSSENETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 895 - protein, 632 aa, Artificial Sequence
  Recombinant HIV protein
AENLWVTVYYGVPVWKEAKTTLFCASDAKGYDKEVHNVWATHACVPTDPNPQEMVLPNVTEDFNMWKNDMVDQMHEDIISLWDESLKPCVKLTPLCVTLTCKNATNDDTAVKEEMKNCSFSVTTELKDKQKQAYALFYRLDIVQLDNKTSSNNKNSSEEKYRLINCNTSACTQACPKVSFDPIPIHYCAPAGYAILKCNNETFNGTGPCTNVSTVQCTHGIKPVVSTQLLLNGSLAEGEIMIRSENITDNVKTIIVHLNESVEIVCTRPDNNTRKSIRIGPGQAFFATGAIIGKIRQAHCNISKGNWSQTLKGVKNKLQEYFPNKTIEFKQPSPGGDLEITMHSFNCRGEFFYCNTSGLFNNTLLNDTLTIDNNETITLPCRIKQIINMWQEVGRCMYAPPIAGNITCKSNITGLLLVRDGGISNGTDNKNETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 896 - protein, 626 aa, Artificial Sequence
  Recombinant HIV protein
AENLWVTVYYGVPVWKDAETTLFCASDARAYEKEAHNIWATHACVPTDPDPQELYLENVTEEFNMWKNNMVEQMHTDIISLWDQSLKPCVQLTPLCVTLNCNDVTNNGTNVANISIDMKGEIKNCSFNMTTELRDKKQKVYSLFYKLDVVQMNSSQYRLINCNTSACKQACPKVSFEPIPIHYCAPAGFAILKCRDEEFDGTGPCTNVSTVQCTHGIKPVVSTQLLLNGSLAEKRVMVRSENITNNVKNIIVQFNETVNITCIRPNNNTRKSVHIGPGQAFYATGDIIGNIRKAHCHVNKTEWNRMLAKAAQQLINHFNKTITFKNSSGGDLEITSHSFNCGGEFFYCDTSSLFNITWDRSNVTQELNNTKLNDTIILQCRIKQIINMWQRAGQCMYAPPIPGIIKCESNITGLILTRDGSENETETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 897 - protein, 645 aa, Artificial Sequence
  Recombinant HIV protein
AENLWVTVYYGVPVWKEATTTLFCASDAKAYNPEMHNVWATHACVPTDPNPQEMVLENVTENFNMWENNMVEQMHEDIISLWDQSLKPCVKLTPLCVTLNCRNANITDITTVDKPIVGDIQNCSFNVTTEINDRKKKMHALFYRLDVVPLNKRNSSTNNNSNNESTMDYRLINCNTSACTQACPKVSFEPIPIHYCAPAGYAILKCNSKTFNGTGPCTNVSTVQCTHGIRPVVSTQLLLNGSLAEEEIIVRSENVTNNAKTIIVHLNESVQINCTRPNNNTRESIRIGPGQSLYANGDIIGDIRQAHCNISRGEWNKTLQQVAEKLGNLFNKTEIIFSPSSGGDPEITTHSFNCGGEFFYCNTTGLFNDSKWQHNNSEWEETSKRMNSPEANITLQCRIKQIVNMWQGVGRCMYAPPIRGVIKCTSNITGLLLTRDGGLNTSNNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 898 - protein, 629 aa, Artificial Sequence
  Recombinant HIV protein
AENLWVTVYYGVPVWKEAKTTLFCASDAKAYEKEVHNVWATHACVPTDPSPQEIVLNVTENFNMWKNDMVDQMHEDVISLWDQSLKPCVKLTPLCVTLNCSDIAKNNSSNGTNNNNITSDMKEEMKNCSFNATTEIRDKKKEMYALFYKLDIVSLVANTSEYRLKNCNTSTCTQACPKVSFDPIPIHYCAPAGFAILKCNDKTFNGTGPCHNVSTVQCTHGIKPVVSTQLLLNGSLAEKEIIIRSANLSDNAKTIIVHLNESVEIVCTRPSNNTRKSIRIGPGQMFFATNEIIGDIRQAHCNISGANWSKTLDRVSEKLRKHFPNKTIIFNSSSGGDPEITTHSFNCGGEFFYCNTSKLFNNTYNGTESNSTITLPCRIKQIINMWQGVGRCMYAPPIAGNITCKSMITGLLLVRDGGTGKNDTENATETFRPEGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 899 - protein, 628 aa, Artificial Sequence
  Recombinant HIV protein
AENLWVTVYYGVPVWKDAETTLFCASDAKAYHTEVHNVWATHACVPTDPNPQEINLENVTEEFNMWKNKMVEQMHTDIISLWDQSLKPCVQLTPLCVTLDCQYNVTNINSTSDMAREINNCSYNITTELRDREQKVYSLFYRSDIVQMNSDNSSKYRLINCNTSACKQACPKVTFEPIPIHYCAPAGFAILKCKDKEFNGTGPCKNVSTVQCTHGIKPVVSTQLLLNGSLAEEKVMIRSENITDNAKNIIVQFKEPVKINCTRPNNNTRKSVRIGPGQTFYATGEIIGDIRQAHCNVSKAHWENTLQEVANQLKLMIHSNKTIIFANSSGGDLEITTHSFNCGGEFFYCYTSGLFNYTFNDTSTNSTESKSNDTITLQCRIKQIINMWQRAGQCVYAPPIPGIIRCESNITGLILTRDGGNNNSNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 900 - protein, 649 aa, Artificial Sequence
  Recombinant HIV protein
AENLWVTVYYGVPVWKEATTTLFCASDAKAYKAEAHNIWATHACVPTDPNPQEIVLGNVTENFNMWKNDMVEQMHEDIISLWEQSLKPCVKLTPLCVTLNCTNATATNATATSQNSTDGSNKTVNTDTGMKNCSFNVTTDLKDKKRQDYALFYKLDVVQIDDKNTNGTNTNYRLINCNTSACTQACPKITFEPIPIHYCAPAGYAILKCNNKTFNGTGPCKNVSTVQCTHGIRPVVSTQLLLNGSLAEEEIVIRSENLTNNAKIIIVQLNEAVTINCTRPSNNTRRSVHIGPGQAIYSTGQIIGDIRKAHCNISRKEWNSTLQQVTKKLGSLFNTTKIIFNASSGGDPEITTHSFNCNGEFFYCNTAGLFNSTWNRTNSEWINSKWTNKTEDVNITLQCRIKQIINMWQGVGKCMYAPPVSGIIRCSSNITGLLLTRDGGGADNNRQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 901 - protein, 629 aa, Artificial Sequence
  Recombinant HIV protein
AENLWVTVYYGVPVWKEAKTTLFCASDAKSYEAEAHNIWATHACVPTDPNPQEIELENVTENFNMWKNNMVEQMHEDIISLWDQSLKPCVKLTPLCVTLNCSNNGTTANITDSGIEIKNCSFNITTEVRDRKKQVYALFYKLDVVPLDTDTNTSNYRLINCNTSACTQACPKVTFEPIPIHYCAPAGYAILKCNDKTFNGTGPCKNVSTVQCTHGIKPVVSTQLLLNGSLAEEEVIIRSENLTNNAKIIIVQLNESVEITCMRPYNNTRQGVHIGPGRAYYTTNIIGNIRQAYCNISSKNWNKTLQQVAKKLGGLVNKTTILFKPPSGGDPEITTHSFNCGGEFFYCNTSGLFNSTWNNSMWNNMLTWNATGNDIMTLPCKIKQIINMWQGVGKCMYAPPIEGLIQCSSNITGLLLTRDGGVNNDSQSETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 902 - protein, 634 aa, Artificial Sequence
  Recombinant HIV protein
AENLWVTVYYGVPVWRDADTTLFCASDAKVHSTEVHNVWATHACVPTDPNPQEIHLENVTENFNMWQNKMAEQMQEDVISLWDQSLKPCIKLTPLCVTLSCTEAKFNETFNKIDNITKVSNLTDEMRNCSFNMTTELRDKKQQVYALFYKLDIVPIDNSSEYRLINCNTSVCKQACPKVSFDPIPIHYCTPAGYAILKCNDKNFNGTGPCKNVSSVQCTHGIKPVVSTHLLLNGSLAEEEIVIRSEDITKNTKTIIVHLNKSVEINCTRPSNNTRTSVRIGPGQVFYRTGEVITSIRKAYCEINGTKWNETLRQVAKKLKEHFKNKTIIFQPPSGGDLEVTTHHFNCRGEFFYCDTAQLFNSTWRGNETKEERNGTSNDIIILPCRIKQIVRMWQGVGQCMYAPPISGIINCVSNITGILLTSDGDGGPTADNETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 903 - protein, 622 aa, Artificial Sequence
  Recombinant HIV protein
AENLWVTVYYGVPVWREATTTLFCASDAKGYEREVHNVWATHACVPTDPNPQEIVLKNVTENFNMWKNDMVDQMHEDIISLWEQSLKPCVKLTPLCVTLICRNVNLTNNNSISGNDSMSGEMRNCSFNMTTELRDKKKNVSALFYKLDVVPIDGRENNSEYRLINCNTSACTQACPKVSFDPIPIHYCAPAGYAILKCNNETFNGTGPCRNVSTVQCTHGIKPVVSTQLLLNGSLAEKDIMIRSENLTNNAKIIIVHLNESIEIKCIRPGNNTRQSIRIGPGQAFYAYTNIIGDIRKAHCKINGTKWNETLEKVKSILREFFNKTVKFQPHSGGDLEVVTHSFNCRGEFFYCNTSQLFNETHTNGTNSTIILPCRIKQIINMWQEVGRCMYAPPIAGNITCTSNITGLLLERDGGKDNNMTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 904 - protein, 636 aa, Artificial Sequence
  Recombinant HIV protein
AENLWVTVYYGVPVWKEAKTTLFCASDAKSYETEAHNIWATHACVPTDPNPQEVELVNVTENFNMWKNDMVDQMHEDIISLWDESLKPCVKLTPLCVTLQCSEMKNGTRGASNSTGTNNGTISSTDRMNCSFNATTVVNDKQKKVHALFYRLDIEPIGNNSTEYMLINCNTSACAQSCPKITFEPIPIHYCAPAGFALLKCRDKQFNGTGPCTNVSSVQCTHGIKPVVSTQLLLNGSLAEEDIIIRSENLTDNTKTIIVQLNKSIAINCTRPYNNTRQRIHIGPGQAIWTNDARVIVGDIRQAHCNVSRVDWNNMTQWAATKLGSLYNRSTIIFNHASGGDPEITTHSFTCGGEFFYCNTSGLFNSTWDIMNTSSPNNTDPIITLQCRIKQIINMWQGVGRCIYAPPIAGQILCSSNITGLLLTRDGGADNSSHNETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 905 - protein, 646 aa, Artificial Sequence
  Recombinant HIV protein
AENLWVTVYYGVPVWREAKTTLFCASDAKGYEKEVHNVWATHACVPTDPNPQEMKLGNVTENFNMWENDMVDQMHEDVISLWDQSLKPCVKLTPLCVTLNCSHAVRVTGNNDTATRKNTTVDNNNTVDDSTMDEQMKNCSFNVTTELRDKEKEQYALFYTVDVVNDSSTYRLINCNSSTCTQACPKVSFDPIPIHYCAPAGYAILKCNNKTFNGTGPCNDVSTVQCTHGIKPVVSTQLLLNGSLAEEEIVIRSKDLNNTGNTIIVHLNKSIEIMCTRPGNNTRQSIRIGPGQTFYATGDIIGDIRQAYCNISKVKWNETLQMVGKKLREHYNFTNKGKIKFSPHPGGDLEVTMHSFNCRGEFFYCNTSKLFNSTYMPGYWPNATERNSTSNITLHCRIKQIINMWQGVARCMYAPPIRGNITCISNITGLLLTWDGDKTSNDPDTDVFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 906 - protein, 629 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDVISLWDQSLKPCVKLTPLCVTLDCKNVNDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKNQVMIRSEHIGNSAKNIIVQFTEPVKINCTRPNNNTRKSVHIGPGQAFYATGDIIGNIRQAYCTVNRTAWNNTLQKVVTRLRTYFGNKTIIFKNSSGGDIEITTHSFNCAGEFFYCNTSSLFNSTWPVSGQGLNSTELGDTITLQCRIKQIINMWQRAGQCIYAPPIPGVIRCESNITGLILTSDYGNNNSDNEIFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 907 - protein, 629 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCKNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKNQVMIRSEHIENNAKNIIVQFTEPVKINCTRPNNNTRKSVHIAPGQAFYATGDIIGNIRQAYCTVNRTAWNNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNSSSDNETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 908 - protein, 629 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 909 - protein, 649 aa, Artificial Sequence
  Recombinant HIV protein
AENLWVTVYYGVPVWKEAKTTLFCASDAKAYEREVHNVWATHACVPTDPNPQEMELKNVTENFNMWKNDMVDQMHEDVISLWDESLKSCVKLTPLCVTLYCTNVNSTAPNSTAATSTTTSSSTTSSSTTTATYNEMTNCSFNATTELRNKEKKEYALFYRLDVVKLNEESDSNSSNSNTYRLINCNTSTCTQACPKVSFEPIPIHYCAPAGYAILKCNNETFNGTGPCNNVSTVQCTHGIKPVVSTQLLLNGSLAEKDIVIRSENLTNNAKIIIVSLNESVSINCTRPNNNTRKGIRIGPGQTFYATGEIIGNIREAHCNISREDWNKTLQRVGKKLEEHFPNKTIIFESHSGGDLEITTHSFNCGGEFFYCNTSALFNSTYNETYRYNATNDTNPTITLKCRIKQIINMWQEVGRCMYAPPIAGNITCRSNITGILLTRDGGPNSTNETFRPEGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 910 - protein, 643 aa, Artificial Sequence
  Recombinant HIV protein
AENLWVTVYYGVPVWKEAKTTLFCASDAKAYEREVHNVWATHACVPTDPNPQEMVLKNVTENFRWENDMVDQMHENIIDLWDQSLKPCVKLTPLCVTLNCSNVNSNVNVTSNGTASQGNATYTNRMEEEIKNCSFNITTEIRGKKQKVHALFYKLDVVPLNGDSSNSSEYRLINCNTSACTQACPKVSFDPIPIHFCAPAGYAILKCNDKTFNGTGPCNNVSTVQCTHGIKPVISTQLLLNGSLAEGEIIIRSKNLTDNVQTITVHLNESISINCTRPNNNTRKSIRIGPGQIFYATGDIIGDIREAHCNISASQWNAALKGVKAKLKEHFSNKTINFTTSSGGDLEITTHSFNCRGEFFYCNTSGLFNETGLFNETHNSTMNDNITLPCRIKQIINMWQEVGRCVYAPPIAGNIACNSNITGLLLTRDGGSINGSEDENNTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 911 - protein, 630 aa, Artificial Sequence
  Recombinant HIV protein
AENLWVTVYYGVPVWKEAKTTLFCASDAKAYEREVHNVWATHACVPTDPNPQEMFLVNVTENFRWENDMVDQMHENIISLWDQSLKPCVKLTPLCVTLTCSSVNVTSQDNATYTNSMKGEIKNCSFNITTEIRDKKKKVHALFYKLDVVPLNGGSNSSEYRLINCNTSACTQACPKVSFDPIPIHFCAPAGYAILKCNDKTFNGTGPCNNVSTVQCTHGIKPVISTQLLLNGSLAEGEIIIRSKNLTDNVQTITVHLNESISINCTRPNNNTRKSIRIGPGQIFYATGDIIGDIREAHCNISARQWNAALKSIKAKLKEHFNKTINFTTSSGGDLEITTHSFNCRGEFFYCNTSGLFNETGLFNETHNSTMNDNITLPCRIKQIINMWQEVGRCIYAPPIAGNIACNSNITGLLLTRDGGSINGSEDNTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 912 - protein, 617 aa, Artificial Sequence
  Recombinant HIV protein
AENLWVTVYYGVPVWREAKTTLFCASDAKAYEKEVHNVWATHACVPTDPDPQEMVLKNVTENFNMWKNDMVEQMHEDIISLWDQSLKPCVKLTPLCVTLTCTNVNATDNVTYKEKMEGEIKNCSFNITTEIRDKKRKVHALFYRLDVVQLNNSNEYILINCNTSACTQACPKVSFDPIPIHYCAPAGYAILKCNDKTFNGTGPCHNVSTVQCTHGIKPVISTQLLLNGSLAEKEVIIRFENLTDNAKTIIVQLNQSIEIKCIRPNNNTRESIRIGPGQAFYATRDIIGDIRRAYCTIETERWKETLGNVTEKLKEYFPNTNISFAPSSGGDLEITTHSFNCRGEFFYCNTSKLFNNNDTENNLTITLPCRIKQIVNMWQGVGRCMYAPPIEGNITCKSNITGLLLTRDGGNGTERNETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 913 - protein, 634 aa, Artificial Sequence
  Recombinant HIV protein
AENLWVTVYYGVPVWREATTTLFCASDAKAYDTEVHNVWATHACVPTDPNPQEVVLGNVTENFNMWKNNMVDQMHEDIISLWDESLKPCVKLTPLCVTLNCTNLNITKNTTNPTSSSWGMMEKGEIKNCSFYITTSIRNKVKKEYALFNRLDVVPIENTNNTKYRLISCNTSVCTQACPKVSFQPIPIHYCVPAGFAMLKCNNKTFNGSGPCTNVSTVQCTHGIRPVVSTQLLLNGSLAEEDIVIRSENFTDNAKTIIVQLNESVVINCTRPNNNTRRRLSIGPGRAFYARRNIIGDIRQAHCNISRAKWNNTLQQIVIKLREKFRNKTIAFNQSSGGDPEIVMHSFNCGGEFFYCNTAQLFNSTWNVTGGTNGTEGNDIITLQCRIKQIINMWQKVGKCMYAPPITGQIRCSSNITGLLLTRDGGNSTETETEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 914 - protein, 640 aa, Artificial Sequence
  Recombinant HIV protein
AENLWVTVYYGVPVWRDAETTLFCASDAKAYDKEAHNVWTTHACVPTDPDPQELPLVNVTEEFNMWKNNMVEQMHEDIISLWDQSLKPCVQLTPLCVTLECADAQNVTDTNTTISNEMQGEIKNCSFNMTTELRDKKKKVYALFYRPDVIEINKTKINNSNSSQYMLINCNTSACTQACPKVSFEPIPIHYCAPAGFAILKCNDTEFSGKGTCKSVSTVQCTHGIKPVVSTQLLLNGSLAEGKIAIRSENISNNAKTIIVQLTEPVEINCIRPGNNTRKSVRIGPGQTFYATGDIIGDIRQAHCNVSKIAWEETLQKIAAQLRKHFQNATIKFTKHSGGDLEITTHSFNCGGEFFYCNTTKLFNSTWNNDNYNVSANLTEENRKENITLHCRIKQIVNMWQRVGQCIYAPPIPGNITCGSNITGLLLTRDGGNNGTNDTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 915 - protein, 642 aa, Artificial Sequence
  Recombinant HIV protein
AENLWVTVYYGVPVWKEAKTTLFCASDAKSYEKEVHNVWATHACVPTDPNPQEIVLGNVTENFNMWKNDMVDQMHEDIISLWDQSLKPCVKLTPLCVTLNCTEVNVTRNVNNSVVNNTTNVNNSMNGDMKNCSFNITTELKDKKKNVYALFYKLDIVSLNETDDSETGNSSKYYRLINCNTSACTQACPKVSFDPIPIHYCAPAGYAILKCNNKTFNGTGPCHNVSTVQCTHGIKPVVSTQLLLNGSLAEEGIIIRSENLTNNVKTIIVHLNRSIEIVCVRPNNNTRQSIRIGPGQTFYATGDIIGDIRQAHCNISRTNWTKTLREVRNKLREHFPNKNITFKPSSGGDLEITTHSFNCRGEFFYCNTSGLFSINYTENNTDGTPITLPCRIRQIINMWQEVGRCMYAPPIEGNIACKSDITGLLLVRDGGSTNDSTNNNTEIFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 916 - protein, 622 aa, Artificial Sequence
  Recombinant HIV protein
AENLWVTVYYGVPVWKEATTTLFCASDAKSYKEEAHNIWATHACVPTDPNPRELIIENVTENFNMWKNNMVEQMHEDIISLWDQSLKPCVKLTPLCVTLNCTEWRKNNTINATGIEMKNCSFNLTTEIRDRKKQVHALFYKLDVVPIDDNNSTNTSYRLINCNTSACTQACPKVTFEPIPIHYCAPAGYAILKCNNKKFNGTGPCNNVSTVQCTHGIRPVVSTQLLLNGSLAEEDIIIRSENLTNNAKIIIVQLNESVTINCTRPYNNTRRGVHIGPGRAYYTTDIIGDIRQAHCNISGAEWNKTLHRVAKKLRDLFKKTTIIFKPSSGGDPEITTHSFNCRGEFFYCNTTRLFNSIWGNNSTGVDESITLPCRIKQIINMWQGVGKCMYAPPIEGLISCSSNITGLLLTRDGGGNESSQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 917 - protein, 640 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 918 - protein, 633 aa, Artificial Sequence
  Recombinant HIV protein
AENLWVTVYYGVPVWKEATTTLFCASDAKAYDTEVHNVWATHACVPTDPNPQEVVLENVTENFNMWKNNMVEQMHEDIISLWDQSLKPCVKLTPLCVTLNCTDLRNVTNINNSSEGMRGEIKNCSFNITTSIRDKVKKDYALFYRLDVVPIDNDNTSYRLINCNTSTCTQACPKVSFEPIPIHYCTPAGFAILKCKDKKFNGTGPCKNVSTVQCTHGIRPVVSTQLLLNGSLAEEEVVIRSSNFTDNAKNIIVQLKESVEINCTRPNNNTRKSIHIGPGRAFYTTGEIIGDIRQAHCNISRTKWNNTLNQIATKLKEQFGNNKTIVFNQSSGGDPEIVMHSFNCGGEFFYCNSTQLFNSTWNFNGTWNLTQSNGTEGNDTITLPCRIKQIINMWQEVGKCMYAPPIRGQIRCSSNITGLILTRDGGTNSSGSEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 919 - protein, 634 aa, Artificial Sequence
  Recombinant HIV protein
AENLWVTVYYGVPVWKEATTTLFCASDAKAYDTEVHNVWATHACVPTDPNPQEVALENVTENFNMWKNNMVEQMHEDIISLWDQSLKPCVKLTPLCVTLNCTDLRNATSRNVTNTTSSSRGMVGGGEMKNCSFNITTGIRGKVQKEYALFYELDIVPIDNKIDRYRLISCNTSVCTQACPKVSFEPIPIHYCAPAGFAILKCKDKKFNGKGPCSNVSTVQCTHGIRPVVSTQLLLNGSLAEEEVVIRSENFTNNAKTIIVQLNESVEINCTRPNNNTRKSINIGPGRAFYTTGEIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQEVGRCMYAPPIRGQIRCSSNITGLLLTRDGGPEDNKTEVFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 920 - protein, 634 aa, Artificial Sequence
  Recombinant HIV protein
AENLWVTVYYGVPVWKEATTTLFCASDAKAYDTEVHNVWATHACVPTDPNPQEVKMENVTENFNMWKNNVVEQMHEDIISLWDQSLKPCVKLTPLCVTLNCTDLKNATNGNNTNTTSSSGGMMGGGEMKNCSFNITTNIRGKVQKEYALFYELDIVPIDNKIDSYRLISCNTSVCTQACPKVSFEPIPIHYCAPAGFAILKCKDKKFNGKGPCSNVSTVQCTHGIRPVVSTQLLLNGSLAEEEVVIRSENFTNNAKIIVVQLNESVEINCTRPNNNTRKSIHIGPGRAFYTTGEIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQEVGRCMYAPPIRGQIRCSSNITGLLLTRDGGPEDDKTEVFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 921 - protein, 629 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNISEGKEEIKNCSFNITTELRDKRKKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGNIRQAHCNVSRSEWNKTLQQVAKQLGKYFGNKKVIFNSSSGGDLEITTHSFNCGGEFFYCNTSGLFNSTWTWDNSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 922 - protein, 640 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLNCSNANVNITGNITGVGEDIKNCSFNMTTELRDKKQKVYSLFYRLDVVQINENQGNSSNNNYSEYRLINCNTSACTQACPKVSFEPIPIHYCAPAGFAILKCKDEEFNGTGPCKNVSTVQCTHGIKPVVSTQLLLNGSIAEKEVKIRSEDITNNAKNILVQLVNPVKINCTRNADNKRRSIRIGPGQAFYATGEIIGDIRKAQCTVNRTDWNNTLQQVANQLRKYLGNKTIIFASSSGGDLEITTHSFNCGGEFFYCNTSGLFNSIWYHNDSSISLDPNSTESNDNITLPCRIKQIINMWQRAGQCMYAPPIEGVIMCVSNITGLILTRDGGNDSSTNENETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 923 - protein, 650 aa, Artificial Sequence
  Recombinant HIV protein
AENLWVTVYYGVPVWKEATTTLFCASDAKAYETEVHNVWATHACVPTDPNPQEVKLENVTEDFNVWKNDMVTQMHEDIISLWDQSLKPCVKLTPLCVTLHCTDVNTTCITTNNSTMTNSSNSSTEGNCSSYNYNGREELRNCSFNITTSIQDKVQDYAIFYKLDIVPIKSDNSDNTSYRLINCNTSVCTQACPKISFEPIPIHYCAPAGFAILKCNDKKFSGKGTCNNVSTVQCTHGIRPVVSTQLLLNGSLAEEGVVLRSENFTNNAKTIIVQLKDPVKIECERPNNNTIKSIHLGPGRAWHATGQIIGDIRKAFCTLNSTNWTNTLKQMVEKLREQFENKTIAFNQSTGGDPEIVMHTFNCGGEFFYCNTTQLFNSIWYNTTNSSWNNKTWSNNTITLPCRIKQIINMWQQVGKCIYAPPIKGKIKCISNITGLLLTRDGGDTNNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 924 - protein, 648 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 925 - protein, 643 aa, Artificial Sequence
  Recombinant HIV protein
AENLWVTVYYGVPVWKEATTTLFCASDAKAYDKEKHNVWATHACVPTNPNPQEIDLINVTEEFNAWENNMVEQMHEDIISLWDQSLKPCVELTPLCVTLNCTDQRKNTSPLGEAEKMEKGEMKNCSFKVTTRLRNKVQKEYALFNKLDVVPIDNDNKTNTNYSSYKLISCNTSVCTQACPKVSFEPIPIHYCAPAGFAILKCKDKKFNGTGRCENVSTVQCTHGIRPVVSTQLLLNGSLAEEEVVLRSKNFTQNAETIIVQLNESVVINCTRPNNNTKRSITRGPGRVYYTTGDIVGDIRQAHCNLSRAHWNTTLGHIARKLREKYGENKTIIFNPPIRGGDPEIVMHNFNCGGEFFYCNSTQLFNSTWNDNSDWTWNYTRGTYNPNDTITLPCRIKQIINLWQKVGKCMYAPPIRGQIRCLSNITGLLLTRDGGKNGTEGTEIFRPIGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 926 - protein, 630 aa, Artificial Sequence
  Recombinant HIV protein
AENLWVTVYYGVPVWKEAKTTLFCASDAKAYDTEVHNVWATHACVPTDPNPQEMVLENVTENFNMWENDMVEQMHQDIISLWDQSLKPCVKLTPLCVTLHCSNRTIDYNNRTDNMGGEIKNCSFNMTTEVRDKREKVHALFYRLDIVPLKNESSNTSGDYRLINCNTSACTQACPKVSFDPIPIHYCAPAGYAILKCNNKTFNGTGPCNNVSTIQCTHGIKPVMSTQLLLNGSLAEEEIIIRSKNLTDNVKTIIVHLNESVGINCTRPNNNTRKSIRIGPGQAFYATGEIIGDIRQAHCNISRTAWNKTLQEVGKKLAEHFLNKAIKFAKHSGGDLEITTHSFNCRGEFFYCNTSSLFNSTYTPNSTENITGTENSIITIPCRIKQIINMWQGVGRCMYAPPIEGIITCRSNITGLLLTRDGGTGMHDTEIFRPEGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 927 - protein, 630 aa, Artificial Sequence
  Recombinant HIV protein
AENLWVTVYYGVPVWKEATTALFCASDAKTYDTEVHNVWATHACVPTDPDPQEVELENVTENFNMYKNNMVEQMHEDIINLWDQSLKPCVKLTPLCVTLNCTDLRNATIENVTNPNMKMNKGDIKNCSFHITKNRRGKTQTGYALFSKLDLVPVNDSEYILISCNTSTCTQACPKVSFEPIPIHYCAPAGFAILKCKDKKFNGTGPCKNVSTVQCTHGIRPVVSTQLLLNGSLAEEDVVIRCENFTNNAKTIIVQLNESVVINCTRPNNNTRRGISMGPGRAFLAREQIIGNIRQAHCNLSRTQWSNTLKQTVKKLREQFRNKTIVFNQSSGGDPEIVLHSFNCGGEFFYCNTTQLFNSTWNITRNDNEGSNSTEDIITLPCRIKQIVNLWQEVGKCMYAPPISGQIRCSSNITGLLLTRDGGNTSSEAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 928 - protein, 617 aa, Artificial Sequence
  Recombinant HIV protein
AENLWVTVYYGVPVWKDAETTLFCASDAKAYETEKHNVWATHACVPTDPNPQEMDLENVIEEFNMWKNNMVEQMHTDVISLWDQSLKPCVKLTPLCVTLDCSNHKSIMGEEVKNCSFNMTTELRDKKQKVYSLFYKLDVVPLDEANGNNNSSYRLVNCNTSACTQACPKVTFEPIPIHYCAPAGFAILKCKDKEFSGTGPCKNVSTVQCTHGIKPVVSTQLLLNGSLAEEHVMIRSENITNNAKNILVQLNESVEIYCIRPSNNTRKSVRIGPGQTFYATGEIVGDIRQAHCNVSGSKWNKTLQQVADQLRKHFNTTTIIFANPLGGDLEITTHSFNCGGEFFYCNTSGLFNSTWPSSTQESSDPITLQCRIKQIINMWQRVGQCMYAPPIQGEIRCNSSITGIILTRDGGYNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 929 - protein, 624 aa, Artificial Sequence
  Recombinant HIV protein
AENLWVTVYYGVPVWKDATTTLFCASDAKAYDKEVHNVWATHACVPTDPNPQEVVLGNVTENFNMGKNNMVEQMHEDIISLWDQSLKPCVKLTPLCVTLNCTELKNSTDTNLGTQEIKNCSFNITTSVRNKMKREYALFYSLDIVPIDNDNTSYRLRSCNTSICTQACPKVSFEPIPIHFCAPAGFAILKCNNKTFNGTGPCTNVSTVQCTHGIRPVVSTQLLLNGSLAEEEVVIRSENFTNNAKTIIVQLNESVEINCTRPNNNTRKSIHIGPGRAFYTTGDIIGDIRQAHCNISRTNWTNTLKRVAEKLREKFNNTTIVFNQSSGGDPEIVMHSFNCGGEFFYCNTTQLFNSTWNETNSEGNITSGTITLPCRIKQIINMWQEVGKCMYAPPIGGQIKCLSNITGLLLTRDGGSDNSSSGKEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 930 - protein, 631 aa, Artificial Sequence
  Recombinant HIV protein
AENLWVTVYYGVPVWKDADTTLFCASDAKAHETEAHNIWATHACVPTDPNPQEIYMENVTENFNMWKNNMVEQMQEDIISLWDQSLKPCVKLTHLCVTLSCTNVTLTNVNYTNNFPNIGNITDEVRNCSFNVTTEIRDKKQKVYALFYKTDIVQMENKNSYRLINCNTSVCKQACPKISFDPIPIHYCTPAGYAILKCNEKNFNGTGPCKNVSSVQCTHGIKPVVSTQLLLNGSLAEGEIIIRSENLTNNAKTIIVHLNKSVEINCTRPSNNTRTSVTIGPGQVFYRTGDIIGDIRKAYCEINGTKWNETLKQVVGKLKEHFPNKKISFQPPSGGDLEITMHHFNCRGEFFYCNTTQLFNSTWINSTGIKEYNDTIIYLPCKIKQIINMWQGVGQCMYAPPIRGKINCVSNITGILLTRDGGDANATNDTETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 931 - protein, 626 aa, Artificial Sequence
  Recombinant HIV protein
AENLWVTVYYGVPVWRDADTTLFCASDAKTHVTEVHNVWATHACVPTDPNPQEIHLGNVTENFNMWKNKMAEQMQEDVISLWDQSLKPCVRLTPLCVTLNCTSANLTNVNNITYAPGIEKITDEVRNCSFNMTTEIKDKKQKVSALFYKLDIVQINSSKNSSEYRLINCNTSVCKQACPKISFDPIPIHYCTPAGYAILKCNDKSFNGTGPCKNVSSVQCTHGIKPVVSTQFLLNGSLAEEEIIIRSENLTNNAKIIIVHLNKSVEINCTRPFNNTRTSVHIGPGQVFYRTGDIIGDIRAVYCEINETQWNETLKQVTRKLEEHFNKTIIFQPPSGGDLEITMHHFNCRGEFFYCNTSKLFNTTNGTIAGSNGTIILPCRIKQIVNMWQGAGQCMYAPPISGRINCVSNITGILLTRDGGNNNTNETFRPAGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 932 - protein, 636 aa, Artificial Sequence
  Recombinant HIV protein
AENLWVTVYYGVPVWRDAKTTLFCASDAKAHEREVHNVWATHACVPTDPNPQEILMKNVTENFNMWTNNMVEQMQEDVISLWDQSLKPCVKLTPLCVTLNCTKANLTSDTTNRTTGNRIDEVGNMTDEVKNCTFNMTTELKDKKQKVHALFYKLDIVPIKGNENSSGEYRLINCNTSVCKQACPKISFDPIPIHYCTPAGYAILKCNDKNFNGTGPCKNVSSVQCTHGIKPVVSTQLLLNGSLAEEEIIIRAENLENNAKTIIVHLNKSVEINCTRPSNNTRTSIPIGPGQVFYRTGDIIGNIRKAYCEINGTKWHKVLKQVAEKLREHFINKTIKFRPPLGGDLEITMHHFNCRGEFFYCNTTKLFNSTYRENETREGNDSTIIIPCKIKQIINMWQGTGQCMYAPPISGNINCVSNITGILLTRDGGNNSADNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 933 - protein, 627 aa, Artificial Sequence
  Recombinant HIV protein
AENLWVTVYYGVPVWRDADTTLFCASDAKAQETEAHNIWATHACVPTDPNPQEIHLENVTENFNMWKNNMVEQMQEDVISLWDQSLKPCVKLTPLCVTLNCTTAKVINATIPANVSNIMGNITDEVRNCSFNMTTELRDRKQKAYALFYKLDIVQIKDNKNSSSEYRLINCNTSVCKQACPKVSFDPIPIHYCTPAGYALLKCNDKNFNGTGPCNNVSSVQCTHGIKPVVSTQLLLNGSLAEEEIIISSENLTNNAKTIIVHLNKSVEINCTRPSVNTRTSMHIGPGQVLYRTGDIIGDIRNAYCEIDGTKWSEALELVTEKLKKHFSEIKFQPPSGGDLEITMHHFNCKGEFFYCNTSQLFNNNHKECNGTITLPCRIKQIINMWQGAGQCMYAPPISGKINCVSNITGILLTRDGGTNNNTNSSETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 934 - protein, 633 aa, Artificial Sequence
  Recombinant HIV protein
AENLWVTVYYGVPVWKEATTTLFCASDAKGYEKEVHNVWATHACVPTDPNPQEVVLENVTENFNMWKNNMVEQMHEDIISLWDQSLKPCVKLTPLCVTLNCSDVNTTSVNTTASSMEGGEIKNCSFNTTTSMSDKMQKEYALFYTLDVVPIVKENNTYRLISCNTSVCTQACPKVSFEPIPIHYCAPAGFAILMCNNKTFDGKGPCNNVSTVQCTHGIKPVVSTQLLLNGSLAEEEVVIRSDNFTDNAKTIIVHLNESIEITCTRPNNNTSKSITIGPGRAFYATGRIIGDIRKAHCNISGEKWHNALEQIVKKLGEKFENATTIRFNQSSGGDQEIVMHTFNCGGEFFYCNSTQLFNSTWWPNGTTTEWSNETSNGTITLPCRIKQIINMWQEVGKCMYAPPISGPISCSSNITGLLLVRDGGNDNETNGTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 935 - protein, 639 aa, Artificial Sequence
  Recombinant HIV protein
AENLWVTVYYGVPVWKEAKTTLFCASDAKGYDTEVHNVWATHACVPTDPNPQEIVLENVTENFNMWKNDMVDQMHQDIISLWDQSLKPCVKLTPLCVTLNCSDATYNNGTNSTDTMKICSFNATTELRDKKKKEYALFYRLDIVPLKNESESQNFSEYILINCNTSTCAQACPKVSFDPIPIHYCAPAGYAILKCNNKTFNGTGPCNNVSTVQCTHGIKPVVSTQLLLNGSLAEEEVVIRSENISNNVKTIIVHLNESVNITCIRPGNNTRRSIRIGPGQAFYAMGDIIGNIREAHCNISEKAWNETLKKVVEKLVKYFPNKTIEFAPPVGGDLEITTHSFNCGGEFFYCNTTKLFNSTHNSTDSTVNSTDSTAETGNSTNTNITLPCRIRQIINMWQEVGRCMYAPPSKGNITCISNITGLLLTRDGGENKTENNDTEIFRPGGGDMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 936 - protein, 646 aa, Artificial Sequence
  Recombinant HIV protein
AENLWVTVYYGVPVWKEAKTTLFCASNAKAYEKEVHNVWATHACVPTDPNPQEMVLGNVTENFNMWKNDMVDQMHEDIISLWDESLKPCVKLTPLCVTLICTNVNHSSTNVSHSSTNVSQSSNSSQDNTTIDESMREEIKNCSYNSTTELWDKKQKEYALFYKLDIVPINGNASEYRLINCNTSTCKQACPKVTFEPIPIHYCAPAGYAILKCNNQTFNGTGPCTNVSTVQCTHGIKPVVSTQLLLNGSLAEKEIIISSENLTNNAKIIIVHLKDPVRIVCTRPNNNTRKSIRIGPGQTFYATGDIIGDIRQAYCNIDKGAWNKTLQQVGKKLQEHFPGKTIKFNSSSGGDLEITTHSFNCRGEFFYCNTSKLFNNTYYNGTGNANSTHENITLPCRIKQIIRMWQKVGQCMYAPPIAGNITCTSNITGLLLVRDGGEANGTNNIETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 937 - protein, 618 aa, Artificial Sequence
  Recombinant HIV protein
AENLWVTVYYGVPVWKEAKATLFCASDARAYEKEVHNVWATHACVPTDPNPQEIYLGNVTENFNMWKNDMVDQMHEDIISLWDQSLKPCVKLTPLCVTLRCTNATINGSLTEEVKNCSFNITTELRDKKQKAYALFYRPDVVPLNKNSPSGNSSEYILINCNTSTCTQACPKVSFDPIPIHYCAPAGYAILKCNNKTFNGTGPCNNVSTVQCTHGIKPVVSTQLLLNGSLAEEDIIIKSENLTNNIKTIIVHLNKSVEIVCRRPNNNTRKSIRIGPGQAFYATNDIIGDIRQAHCNINNSTWNRTLEQIKKKLREHFLNRTIEFEPPSGGDLEVTTHSFNCGGEFFYCNTTRLFKWSSNVTNDTITIPCRIKQFINMWQGAGRCMYAPPIEGNITCNSSITGLLLTRDGGKTDRNDTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 938 - protein, 634 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 939 - protein, 645 aa, Artificial Sequence
  Recombinant HIV protein
AENLWVTVYYGVPVWKDATTTLFCASDAKGYETEVHNVWATHACVPTDPNPQELVLGNVTENFNMWKNDMVDQMHEDVISLWDQSLKPCVKLTPLCVTLKCKDVSINNGNVSSSNGSTSHNNSSIDNETLNEGMKEMKNCSFNATTVLRDKKQKVHALFYRLDIVPLNESNKNSRKYRLINCNTSACTQACPKVTFDPIPIHYCAPAGYAILKCNNKTFNGTGPCRNVSTVLCTHGIKPVVSTQLLLNGSLAEEDIIIRSENLTNNAKTIIVHLNESVEIVCTRPGNNTRKGIGIGPGQTFYATGEIIGDIRKAHCNISKDNWTETLYRVSRKLKHFWNKTIIFAPHSGGDLEITTHSFNCRGEFFYCNTSGLFNGTLNDTYMHNSTKSNETITIPCKIRQIVRMWQQVGQCMYAPPIEGNITCKSNITGLLLVRDGGNINRTNETFRPEGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 940 - protein, 636 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 941 - protein, 642 aa, Artificial Sequence
  Recombinant HIV protein
AENLWVTVYYGVPVWKEATTILFCASDAKAYDTEAHNVWATHACVPTDPNPQEIFLVNVTENFNMWKNEMVNQMHEDVISLWDQSLKPCVKLTPLCVTLKCKNVNSTGKNVTSTSNGTYNSTYREEMKNCSFNATTALRDRKQTVYALFYRLDIVPLDEKSSSENSRGYYRLINCNTSACTQACPKVTFDPIPIHYCSPAGYALLKCNDKMFNGTGPCSNVSTVQCTHGIKPVVSTQLLLNGSLAEEEIIIRSENLTNNVKTIIVHLNQSVEIICTRPGNNTRKSIRIGPGQTFYATGDIIGDIRQAHCNISRDKWNETLQRVSKKLAEHFPNKTIKFASSSGGDLEITTHSFNCRGEFFYCNTSGLFNGTYMHNGTQSNSSNSSSIITIPCRIKQIINMWQEVGRCMYAPPIAGNITCKSNITGLLLVRDGGETNQTNFTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 942 - protein, 625 aa, Artificial Sequence
  Recombinant HIV protein
AENLWVTVYYGVPVWKEATTTLFCASDARAYDTEVHNIWATHACVPTDPNPQEVVLGNVTENFNMWINDMVEQMHEDIISLWDQSLKPCVKLTPLCVTLNCSNLNTTNTSSTIEGGEIKNCSFNITTSISTKVKDYAIFNKLDIVPIGNDTTSYILINCNTSVCTQACPKVSFEPIPIHYCTPAGFAILKCNNKTFQGTGPCTNVSTVQCTHGIRPVVSTQLLLNGSLAEEEVVIRSSNFSNNAKVIIVQLNKSVEINCTRPNNNTRKSISLGPGRAWYATGQIIGNIRQAHCNLSRTEWNNTLKQIVNKLREQYGNKTIIFNQSSGGDLEIVMHSFNCGGEFFYCNTSQLFNSTWNVTGTVNGTTGNGTITLPCSIKQIVNRWQEVGRCIYAPPIRGQIRCSSNITGLLLTRDGGNESTTTETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 943 - protein, 630 aa, Artificial Sequence
  Recombinant HIV protein
AENLWVTVYYGVPVWKEATTTLFCASDAKAYDTEVHNIWATHACVPTDPNPQEVVLGNVTENFNMWKNDMVEQMHEDIISLWDQSLKPCVKLTPLCVTLNCTNLRNTNNTSSNTSNMTEGGEIKNCSFDITTSIRTKVKDYALFYELDIVAIDNTSYRLRQCNTSVCTQACPKISFEPIPIHYCTPAGFAILKCNNKTFNGTGPCTNVSTVQCTHRIRPVVSTQLLLNGSLAEEEVVIRSSNFTDNAKVIIVQLKESVEINCTRPNNNTRKSIPLGPGKAWYTTGQIIGDIRQAHCNLSRAKWENTLQQITKKLREQFGNKTIIFNQSSGGDPEVVTHSFNCGGEFFYCNTSQLFNSTWYNNSTWNDTNDTTENSTITLPCRIKQIVNMWQEVGKCMYAPPIRGQIRCSSNITGLLLTRDGGKNESNTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 944 - protein, 627 aa, Artificial Sequence
  Recombinant HIV protein
AENLWVTVYYGVPVWKDATTTLFCASDAKAYDTEVHNVWATHACVPTDPNPQEVVLGNVTENFNMWKNNMVEQMHEDIISLWDQSLKPCVKLTPLCVTLNCANLGNTTNTSSNTSSTTEGGEIKNCSFNINTNIRTKVKDYALFYKLDVVPIDNDNTSYRLRHCNTSVCTQACPKVSFEPIPIHYCTPAGFAILKCNNKTFNGTGPCTNVSTVQCTHGIRPVASTQLLLNGSLAEEEVVIRSSNFTNNARVIIVQLNESVEINCIRPNNNTRKSIPLGQGRAWYTTGQIIGDIRQAHCNLSRTKWNDTLKQITEKLREQFGNKTIIFNQSSGGDPEIVMHSFNCGGEFFYCNTSQLFNSTWNASSTWNDTTENITLPCRIKQIVNMWQEVGKCMYAPPIRGQIRCSSNITGLLLTRDGGDNENTTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 945 - protein, 626 aa, Artificial Sequence
  Recombinant HIV protein
AENLWVTVYYGVPVWREAKTTLFCASDAKAYDTEVHNVWATHACVPTDPNPQEMDLENVTENFNMWKNEMVNQMHEDVISLWDQSLKPCVKLTPLCVTLECKDANATRNHTIANETQGEIKNCSFNATTEVKDKKQKVYALFYRLDIVPLNGKSDTYTYRLINCNTSACTQACPKVTFDPIPIHYCAPAGYAILKCKDKTFNGIGSCHNVSTVQCTHGIKPVVSTQLLLNGSLAESEIIIRSENLTDNVKTIIVHLNQSVEIVCTRPNNNTRKSIRIGPGQIFYATGDIIGDIRQAHCSINAGKWDETLQRVSERLKEHFPNKTIKFEPSSGGDLEITTHSFNCRGEFFYCNTSGLFNGTYNMTNGTSDNSTIIIPCRIKQIINMWQEVGRCMYAPPIEGNITCKSNITGLLLVRDGGNEDKNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 946 - protein, 644 aa, Artificial Sequence
  Recombinant HIV protein
AENLWVTVYYGVPVWRDADTTLFCASDAKAYDPEVHNVWATHACVPTDPNPQEIYLENVTENFNMWKNRMAEQMQEDVINLWDQSLKPCVKLTPLCVTLHCTNANLTKVINTTDPRISNETRKEIEKNNIADEVRNCSFNMTTVIRDKRQRVHALFYKLDIVPIVDDSGSNSSSEYRLINCNTSVCKQACPKMSFDPIPIHYCTPAGFAILRCNDKKFNGTGPCKNVSSVQCTHGIKPVVSTQLLLNGSLAEEEIIIRSEDLTNNAKTIIVHLNKSVEINCARPSNNTRTSIALGPGQAWYRTGDITGDIRKAYCEINRTRWKETLKQVAGKLKEHFNTSKIIFQPHSGGDLEITMHHFNCRGEFFYCNTTELFNSTWEENSNWTSTKIDTIKLPCKIKQIINMWQGVGQCMYAPPISGVINCLSNITGILLTRDGGNNSNANETFRPGGGDIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 947 - protein, 653 aa, Artificial Sequence
  Recombinant HIV protein
AENLWVTVYYGVPVWKDAKTTLFCASDAKAYETEVHNVWATHACVPTDPNPQEIFMENVTEDFNMWKNDMVNQMHEDVISLWDQSLKPCVKLTPLCVTLECGNVSVSSNGTVASNKTYVEEMRNCSFNTTTFISDKHKKEHALFYRLDIVPLDDENSNKNCSKNSGQNCSEYYRLINCNTSACTQACPKVSFDPIPIHYCTPAGYALLKCNNKTFNGTGPCHNVSTVQCTHGIKPVVSTQLLLNGSLAEGEIIIRSENLTNNAKTIIVHLNQSVEIVCTRPNNNTRRSIRIGPGQTFFAHGEIIGDIRQAHCNISRNNWTETLQRVSRKLAEHFPNKTINFTSSSGGDLEITTHSFNCRGEFFYCNTSDLFNSTYMSNGTFRFNGTVFNGTGGDSSINITIPCRIKQIINMWQEVGRCMYAPPIAGNITCKSNITGLLLVRDGGTTNNTNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 948 - protein, 638 aa, Artificial Sequence
  Recombinant HIV protein
AENLWVTVYYGVPVWKEAKTTLFCASDAKAYETEVHNIWATHACVPTDPNPQEIVMENVTENFNMWNNDMVDQMHEDVISLWDQGLKPCVKLTPLCVTLKCGNTTKSTTKHSFLNETYKGEIKNCSFNATTLLKDKQKTVYALFYRLDIVPLNDDKNSSDNSSGYYRLINCNTSACTQACPKVSFDPIPIHYCAPAGYAILQCNNKTFNGTGPCHNVSTVQCTHGITPVVSTQLLLNGSLAEGEIVIRSKNLTDNAKTIIVHLNESVEIVCTRPNNNTRKSIRIGPGQTFYATGDIIGNIRLAYCNISEEKWNKTLQRVSKKLAEHFPNKTIKFKASSGGDLEITTHSFNCRGEFFYCNTTRLFNGTYNSTTGTYNGITGSPNSTIIIPCRIKQIINMWQEVGRCIYAPPIEGNITCKSNITGILLVRDGGKTNKTEEIFRPEGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 949 - protein, 645 aa, Artificial Sequence
  Recombinant HIV protein
AENLWVTVYYGVPVWKEATTTLFCASDAKAYDPEVHNIWATHACVPTDPNPQEVVLGNVTENFNMWKNDMVEQMQEDIISLWDQSLQPCVKLTPLCVNLTCTNATATNATATNSTVAPAPNSTAARTMTDYEMKNCSFNITTSTSTKMTGYAVFYNLDVVPIGKGNDTKSYRLLKCNTSVCTQACPKVSFEPIPLHYCAPAGFAILKCNNKTFSGTGPCTNVSTVQCTHGIRPVVSTQLLLNGSLAEEEVVIRSSNFSNNAKTIIVQLKEPVEINCTRPNNNTRKSMTLGPGRAWYTTGQIIGDIRKAHCNLSSTKWHDTLRQIAKKLSKQFGNKTVVFNQSSGGDPEIVMHSFNCGGEFFYCNTAQLFNSTWNTTKIWGNTTEGNNSTIMLPCKIKQIINLWQEVGKCIYAPPIAGRIRCVSNITGLLLTRDGGHNGNGSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 950 - protein, 643 aa, Artificial Sequence
  Recombinant HIV protein
AENLWVTVYYGVPVWKEATTTLFCASDAKAYDTEVHNVWATHACVPADPNPQEMLLKNVTENFNMWKNEMVNQMHEDVISLWDQSLKPCVKLTPLCVTLNCTNVKINSTSNETCIDSGNNSTCNETYKEMRNCSFNATTVVRDKQQKMYALFYKLDIVPLNSGYKNSSDETYRLINCNTSACTQACPKVSFDPIPIHYCTPAGYALLKCNNKTFNGTGPCNNVSTVQCTHGIKPVVSTQLLLNGSLAEEEIIIRSENLTNNAKTIIVHLKEPVNITCERPNNNTRKSIRIGPGQTFYATGDIIGNIREAHCNISRSQWNKTLQGVGEKLAELFPNKTIVFKNSSGGDLEITTHSFNCRGEFFYCNTTDLFNSTYWSNGTYITQSNSSSINITLPCRIKQIINMWQEVGRCIYAPPIAGQITCISNITGLLLLRDGGKEANGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 951 - protein, 636 aa, Artificial Sequence
  Recombinant HIV protein
AENLWVTVYYGVPVWRDADTTLFCASNAKAHSTEVHNVWATHACVPTDPNPQEIYLENVTENFNIWKNNMVEQMQEDIISLWDQSLQPCVKLTPLCVTLHCTTLNITNTTRNVTTPGPNLGNITDEVRNCSFNVTTEIRDKKHKVNALFYKLDIVQIENNNNNSNKYRLINCNTSVCKQACPKISFDPIPIHYCAPAGYAILKCNDKKFNGTGPCKNVSSVQCTHGIKPVVSTQLLLNGSLAEEEIIIRSENITDNAKTIIVHLNESVEINCTRPYNNTRKSITIGPGQVFYRQGEIIGDIRKAYCEINGTRWNTVLKKVKEKLKEHFNNTNITFQQPSGGDLEITTHHFNCRGEFFYCNTTKLFNNTCIEECNETICYNETTYLPCRIKQIINMWQGVGQCMYAPPIEGKISCVSNITGILLTRDGGNNNSTGNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 952 - protein, 630 aa, Artificial Sequence
  Recombinant HIV protein
AENLWVTVYYGVPVWKEAKTTLFCASDAKAHETEVHNVWATHACVPTDPSPQEIVMENVTEDFNMWNNDMVNQMHEDVISLWDQSLKPCVKLTPLCVTLECRNVSSNGTYNETYNEIKNCSFNATTLLRDKPKKVYALFYRLDIVPLNGENSSGKYRLINCNTSACTQACPKVSFDPIPIHYCTPAGYVILKCNDKTFDGTGQCHNVSTVQCTHGIKPVVSTQLLLNGSLAEEEIIIRSENLTNNAKTIIVHLNESVEIICTRPNNNTRKSIRIGPGQTFYATGDIIGDIRQAHCNISESRWSKTLYNVSKKLAEHFPKKTINFTSSSGGDLEITTHSFNCRGEFFYCNTSRLFNSTYNGTYMFNGIYNTTDNASSIITIPCRIKQIINMWQEVGRCMYAPPIEGNITCNSSITGLLLVRDGGSQPNNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 953 - protein, 619 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 954 - protein, 629 aa, Artificial Sequence
  Recombinant HIV protein
AENLWVTVYYGVPVWRDADTTLFCASDAKAHSTEVHNIWATHACVPTDPNPQEIHMINVTESFNMWKNKMVEQMQEDVISLWDQSLQPCVKLTPLCVTLNCTKVKLTNFKETNDSNIGNITNEIANCTFNMTTELIDKTKQVYALFYKLDIVQIENNSNSSEYRLINCNTSVCKQACPKVSFDPIPIHYCTPAGYAILKCNDKKFNGTGPCKDVSSVQCTHGIKPVVSTQLLLNGSLAEEEIIIRSENLTNNAKTIIVHLNKSVEINCTRPSNHQRKRITMGPGRVYYSTGEITGDIRKAYCKINGTKWNETLKQVAKKLQEHFKNKTIIFKPPSGGDLEITMHHFICRGEFFYCNTTKLFNSTWKGNETMEGNNNTIIPCRIKQIVNMWQRVGQCMYNPPINGTINCVSNITGILLTRDGGDNTTDSETFRPGGGDIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 955 - protein, 625 aa, Artificial Sequence
  Recombinant HIV protein
AENLWVTVYYGVPVWKEATTTLFCASDAKAYDAEVHNVWATHACVPTDPNPQEVVLGNVTETFDMWKNNMVEQMHEDIISLWDQSLKPCVKLTPLCVVLNCTNPTNTSSRTNSTTDMKNCSFDVTTNIQTKVKEYALFYKLDVIPIDDNNNISYRLRHCNTSVCTQACPKVSFEPIPIHYCAPAGFAIIKCNNKMFNGTGPCTNVSTVQCTHGIRPVVSTQLLLNGSLAEEEVVIRSRNFTDNARVIIVQLNDSVEINCTRPNNNTRKRVTLGPGRVWYTTGQIIGDIRKAHCNLSIAKWNNTLKKITEKLKEQFGNKTIIFKQPSGGDLEVVMHSFNCGGEFFYCNTSQLFNETWTWNNSTRNDNTGNGTITLPCRIKQIVNMWQEVGKCMYAPPIRGQIRCSSNITGLLLTRDGGNNTDKNTEIFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 956 - protein, 650 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 957 - protein, 634 aa, Artificial Sequence
  Recombinant HIV protein
AENLWVTVYYGVPVWRDAETTLFCASDAKAHETEVHNVWATHACVPTDPNPQEIFLKNVTENFNMWRNNMVEQMQEDVVSLWDQSLKPCVKLTPLCVTLKCSNANLTKANLTTVSNIGNITDEIRNCSFNMTTELRDKRQNVYALFYKLDIVQLNENSNNSDEYRLINCNTSVCKQACPKVSFDPIPIHYCTPAGYAILKCNDKNFNGTGPCRNVSSVQCTHGIKPVVSTQLLLNGSLAEEEIIIRSENLTNNAKTIIVHLNKSVEINCIRPSTNTRTSVRIGPGQVFYRTGDIIGDIRKAYCEINGTKWNETLTQVAGKLREHFNTTIIFQPPSGGDLEITMLHFNCRGEFFYCNTSQLFNSTWNNTGENNTMERGNGTDTIILPCKIKQIINMWQGVGQCMYAPPISGNISCVSNITGILLTRDGGNNMTNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 958 - protein, 634 aa, Artificial Sequence
  Recombinant HIV protein
AENLWVTVYYGVPVWKEANTNLFCASDAKAYETEVHNVWATHACVPTDPNPQEVFLENVTENFNMWKNNMVEQMHEDIISLWDQSLKPCVKLTPLCVTLNCTNVTTNGTSTNVTDVQEMKNCSFNATTEVRDRKHKEYALFYRLDIVPLDKENSSSKENSSSEYYRLINCNTSACTQACPKVTFDPIPIHYCTPAGHAILKCNDKTFNGTGPCPNVSTVQCTHGIKPVVSTQLLLNGSLAENITIRSEDLANNVKTIIVHLDQAVEIVCTRPNNNTRKSIRIGPGQTFYATGKIIGNIREAHCNISKWNETLLRVSKKLAEHFPNRTIKFEPSSGGDLEITTHSFNCRGEFFYCNTSQLFNSIYQPNDTYMHNGAGNNSDITIPCRIKQIINMWQEVGRCMYAPPVEGNITCKSNITGLLLLRDGGINGTNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 959 - protein, 644 aa, Artificial Sequence
  Recombinant HIV protein
AENLWVTVYYGVPVWRNAETTLFCASDAKAYDAEAHNVWATHACVPTDPNPQEIHLKNVTEKFNMWKNNMVEQMHEDIISLWDQSLKPCVKLTPLCVTLDCHNVNSSNSSTSNSSNSSTPINRTIDSDMQEEIKNCSFNMTTELRDKKQKVSALFYRLDVVQINESSNSQYRLINCNTSACTKACPKVTFEPIPIHYCAPAGFAILKCNDKKFNGTGLCKNVSTVQCTHGIKPVVSTQLLLNGSLAEEEVVIRSEDITNNAKNIIVQLVAPVRINCTRPNNNTRRSVRIGPGQTFYATGDIIGDIRQAHCNVSRSEWNRTLQQVAAQLRKHFNKTIIFANSSGGDIEITTHSFNCGGEFFYCNTSELFNSTWNSTWDNSSNHIESNHTEGNITLQCRIKQIVNMWQKVGLCMYAPPISGEIRCKSNITGLLLTRDGGSNNSTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 960 - protein, 628 aa, Artificial Sequence
  Recombinant HIV protein
AENLWVTVYYGVPVWTEAKTTLFCASDAKAYEREVHNVWATHACVPTDPNPQEIVLGNVTENFNMWKNDMVDQMHEDIISIWDQSLKPCVKLTPLCVTLNCTDVKVNATSNGTTTYNNSIDSMNGEIKNCSFNITTEIRDKKQKVYALFYRPDVVPLNENSSSYILINCNTSTCTQACPKVSFDPIPIHYCAPAGYAILKCNNKTFNGTGPCHNVSTVQCTHGIKPVVSTQLLLNGSLAEEEIIIRSENLTNNAKTIIVHLNESIEIVCTRPNNNTRKSIRIGPGQTVYATNDIIGDIRQAHCNISKTKWNTTLEKVKEKLKEHFPSKAITFQPHSGGDLEVTTHSFNCRGEFFYCDTTKLFNESNLNTTNTTTLTLPCRIKQIVNMWQGVGRCMYAPPVEGNITCNSSITGLLLVRDGGNTSNSTPEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 961 - protein, 616 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCTNAPAYNNSMHGEMKNCSFNTTTEIRDRKQKAYALFYKPDVVPLNRREENNGTGEYILINCNSSTCTQACPKVTFDPIPIHYCAPAGYAILKCNNKTFNGTGPCNNVSTVQCTHGINPVVSTQLLLNGSLAEEEIIIRSENLTNNIKTIIVHLNKSVEIVCTRPNNNTRRSIRIGPGQTFYATGEIIGNIREAHCNISKSSWTSTLEQVKKKLKEHYNKTIEFNPPSGGDLEVTTHSFNCRGEFFYCNTTKLFSNNSDSNNETITLPCKIKQIINMWQKVGRCMYAPPIEGNITCKSNITGLLLTRDGGKNTTNEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 962 - protein, 631 aa, Artificial Sequence
  Recombinant HIV protein
AENLWVTVYYGVPVWTEAKTTLFCASDAKAYEKEVHNVWATHACVPTDPNPQEIFLKNVTENFNMWKNDMVDQMHEDIISLWDQSLKPCVKLTPLCVTLNCVTYNNSMNSSATYNNSMNGEIKNCSFNTTTELRDKKQKVYALFYRTDVVPLNNNNNNSEYILINCNTSTCTQACPKVSFDPIPIHYCAPAGYAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRCMYAPPIEGNITCNSNITGLLLTRDGGGNVTEINRTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 963 - protein, 634 aa, Artificial Sequence
  Recombinant HIV protein
AENLWVTVYYGVPVWKEAKTTLFCASDAKAHKEEVHNIWATHACVPTDPNPQEIVLKNVTENFNMWKNDMVDQMHEDIISLWDQSLKPCVKLTPLCVTLNCSDVKIKGTNATYNNATYNNNNTISDMKNCSFNTTTEITDKKKKEYALFYKLDVVALDGKETNSTNSSEYRLINCNTSACTQACPKVSFDPIPIHYCAPAGYAILKCNNKTFNGTGPCNNVSTVQCTHGIKPVVSTQLLLNGSLAEEEVVIRFENLTNNAKIIIVHLNESVEINCTRPSNNTRKSVRIGPGQTFFATGDIIGDIRQAHCNISRKKWNTTLQRVKEKLKEKFPNKTIQFAPSSGGDLEITTHSFNCRGEFFYCYTSDLFNSTYMSNNTGGANITLQCRIKQIIRMWQGVGQCMYAPPIAGNITCKSNITGLLLTRDGGKEKNDTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 964 - protein, 630 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 965 - protein, 625 aa, Artificial Sequence
  Recombinant HIV protein
AENLWVTVYYGVPVWKEAITTLFCASDAKAYKTEAHNIWATHACVPTDPNPQEVILENVTENFNMWKNNMVDQMHEDIISLWDQSLKPCVKLTPLCVTLKCTNVNSTTSTNSSEEGIGEMKNCSFNITTSVKDKVQKEYALFYRLDIVPIDNTSYRLVKCNTSVCTQACPKVSFEPIPIHYCAPAGFAILKCRDKKFNGTGPCKNVSTVQCTHGIRPTVSTHLLLNGSLAEEEVVIRSENFTKNEKTIIVQLNQSVEITCIRPYNNTRKSIHMGPGRAFYATGEIIGDIRKAHCNVNKTKWHEALKKIAKKLEEQYNNNKTISFNQSTGGDPETAMFTFNCGGEFFYCNSSQLFNSTSKQLFNSTWNNTNANIELPCRIRQIVNMWQRIGKCMYAPPISGQINCTSNITGLLLTRDGDKNNKSTEVFRPIGGEMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 966 - protein, 655 aa, Artificial Sequence
  Recombinant HIV protein
AENLWVTVYYGVPVWKEATTTLFCASDAKAYETEVHNVWATHACVPTDPNPQEVLLENVTENFNMWKNNMVEQMQEDIISLWDQSLKPCVKLTPLCVTLECHDVNVNGTANNGTTNVTESGVNSSDVTSNNVTNSNWGTMEKGEIKNCSFNITTNIRDKMQKETAQFYKLDIVPIEDQNKTNNTLYRLINCNTSVCTQACPKVSFEPIPIHYCTPAGFAILKCNDRNFNGTGPCKNVSTVQCTHGIKPVVSTQLLLNGSLAEAEVVIRSENFTNNAKTIIIQLNETVEINCTRPNNNTSKRISIGPGRAFRATKIIGNIRQAHCNISRATWNSTLKKIVAKLREQFGNKTIVFQPSSGGDPEIVMHSFNCGGEFFYCNTTQLFNSTWNSTEESNSTEEGTITLPCRIKQIINMWQEVGKCMYAPPIEGQIRCSSNITGLLLTRDGGNNNKTNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 967 - protein, 629 aa, Artificial Sequence
  Recombinant HIV protein
AENLWVTVYYGVPVWKETTTTLFCASDAKAYDTEVHNVWATHACVPTDPNPQEVVLENVTEDFNMWKNNMVEQMQEDVINLWDQSLKPCVKLTPLCVTLNCKDVNATNTTSSSEGMMERGEIKNCSFNITKSIRNKVQKEYALFYKLDVVPIDNKNNTKYRLISCNTSVCTQACPKVSFEPIPIHYCAPAGFAILKCNNKTFNGKGQCKNVSTVQCTHGIRPVVSTQLLLNGSLAEEKVVIRSDNFTDNAKTIIVQLNESVKINCTRPSNNTRKSIHIGPGRAFYTTGEIIGDIRQAHCNISRAQWNNTLKQIVEKLREQFNNKTIVFTHSSGGDPEIVMHSFNCGGEFFYCNSTQLFNSTWNDTEKSSGTEGNDTIILPCRIKQIINMWQEVGKCMYAPPIKGQIRCSSNITGLLLTRDGGKNESEIEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 968 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDEVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 969 - protein, 638 aa, Artificial Sequence
  Recombinant HIV protein
AENLWVTVYYGVPVWKDAETTLFCASDAKAYETEKHNVWATHACVPTDPSPQEIPLKNVTEKFNMWKNNMVEQMHTDIISLWDQSLKPCVQLTPLCVTLNCSDVTTNNTKVNTTSAPTTTATVNNDNDMKNCSYNITTELRDKKQKRYSLFYRLDVELINKNNSNSTEYVLINCKTSTCTQACPKVSFEPIPKHYCAPAGFAILKCKDKEFNGTGLCKNVSTVQCTHGIKPVVSTQLLLNGSLVEKRVMIRSANITDNTKNIIVQLKEPVEINCTRPNNNTRKGVHIGLGRRFYTTQVVGDIRQAYCNVSKSKWNDTLKKVVYQLRKYFNKTIIFNSSSGGDVEITTHMFTCGGEFFYCNTSGLFNSTWPVNASEQESNSTESDGIITLRCRIKQIINMWQRTGQCMYAPPIQGIIKCVSNITGLLLTRDGGNSTVNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 970 - protein, 631 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 971 - protein, 634 aa, Artificial Sequence
  Recombinant HIV protein
AENLWVTVYYGVPVWKDAETTLFCASDAKAYATEKHNVWATHACVPTDPNPQEIHLENVTEEFNMWKNNMVEQMHTDIISLWDQSLKPCVKLTPLCVTLNCSNANVRYSNATVNNTIKDEIKNCSFNTTTALRDKRQKVYSLFYRLDIVQIDNSSSDSSSSEYRLINCNTSACTQACPKVTFEPIPIHYCAPAGFAILKCKDEEFNGTGPCKNVSTVQCTHGIKPVVSTQLLLNGSLAKREVKIRTENITNNAKNIIVQFVNPVEINCTRPNNNTRKSIHIGPGQAFYATGDIIGDIRQAHCNVSRSSWNKTLQQVAKQLGTYFKNKTIVFNTSSGGDPEITTHSFNCAGEFFYCDTSGLFNSSWNNNTWKESNSTGSNDTITLLCRIKQIINMWQRTGQCMYAPPIPGLISCKSNITGIILTRDGGNGNSTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 972 - protein, 630 aa, Artificial Sequence
  Recombinant HIV protein
AENLWVTVYYGVPVWKDANTTLFCASDAKAHETEVHNIWATHACVPTDPNPQEMYLANVTENFNMWKNNMAEQMQEDVISLWDQSLKPCVKLTPLCVTLNCTNDISTNGTYNSSDIIGNITDEVRNCSFNMTTELIDKKQKVHALFYKLDIVQIEDDNSNRSMYRLINCNTSVCKQACPKVSFDPIPIHYCTPAGYVILKCNEKNFNGTGPCKNVSSVQCTHGIKPVVSTQLLLNGSLAEDEIIIRSENLTNNAKTIIVHLNESVEINCTRPYNTKIKVTRGPGRVYYRTGEITGDIRKAYCKINGTEWYKTLKQVAGKLREHFNNKTIIFQPPSGGDLEVTMHHFNCRGEFFYCNTTQLFNKTYRGNETMERSNGTIILPCKIKQIINMWQETGQCMYAPPINGEINCISNITGILLTRDGGINRTYNETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 973 - protein, 629 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 974 - protein, 640 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLNCSNANVTSENSTIMGDREEIKNCSFNMTTELRDKRQKVYSLFYRLDVVQINENQGNSSNNNYSEYRLINCNTSACTQACPKVSFEPIPIHYCAPAGFAILKCKDEEFNGTGPCKNVSTVQCTHGIKPVVSTQLLLNGSTAEKEIKIRSENITNNAKIIIVQLVKPVIINCTRPNNNTRRSVHIGPGQAFYATGDIIGNIRQAYCTVNRTDWNNTLQQVAKQLGKHFENKTIIFTKSSGGDLEITTHSFNCGGEFFYCNTSSLFNSTWSHNNSTLLGSNSTESNETITLPCRIKQIVNMWQRTGQCMYAPPIKGVIMCVSNITGLILTRDGGNDNSTNENETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 975 - protein, 649 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNEGNGTAGGEGSNDTVTNREEIKNCSFNMTTELRDKKQRVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAKKEVKIRSENITNNVKTIIVQLVNPVIINCTRPNNNTRKSIRIGPGQSFYAAGAIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIKQIINMWQRTGQCMYAPPIPGVISCVSNITGLLLTRDGGGNNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 976 - protein, 639 aa, Artificial Sequence
  Recombinant HIV protein
AENLWVTVYYGVPVWKEATTTLFCASDAKAYDTEVHNVWATHACVPTDPNPQEVELVNVTENFNMWKNNMVEQMHEDIISLWDQSLKPCVKLTPLCVTLNCTDLRNTTNTNNNTDNNNSKSEGTIKGGEMKNCSFNITTSIGDKMQKEYALLYKLDIVSIDNDSTSYRLISCNTSVCTQACPKISFEPIPIHYCAPAGFAILKCNDKKFSGKGSCKNVSTVQCTHGIRPVVSTQLLLNGSLAEEEVVIRSENFTDNAKTIIVHLNESVQINCTRPNYNKRKRIHIGPGRAFYTTKNIKGTIRQAHCNISRAKWNDTLRQIVSKLKEQFKNKTIVFNPSSGGDPEIVMHSFNCGGEFFYCNTSPLFNSTWNSNNTWNNTTGSNNNITLQCKIKQIINMWQKVGKCMYAPPIEGQIRCSSNITGLLLTRDGGEDTDTNDTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 977 - protein, 625 aa, Artificial Sequence
  Recombinant HIV protein
AENLWVTVYYGVPVWKDAETTLFCASDAKAYETEKHNVWATHACVPTDPNPQEMDLENVIEEFNMWKNNMVEQMHTDIISLWDQSLKPCVKLTPLCVTLDCINHRIINNTNGTIDMGDEIKNCSFNMTTELRDKKQKVYSLFYKLDVVPLDEANGNNNNSYRLVNCNTSACTQACPKVTFEPIPIHYCAPAGFAILKCKDKEFSGTGPCENVSTVQCTHGIKPVVSTQLLLNGSLAEEHVMIRSENITNNAKNILVQLNESVEIYCIRPSNNTRKSVRIGPGQTFYATGEIMGDIRQAHCNVSGSEWNKTLQQVADQLRKHFNTTTIIFANPSGGDLEITTHSFNCGGEFFYCNTSGLFNSTWPSSTQESSDPITLQCRIKQIINMWQRVGQCMYVPPIQGEIRCNSSITGIILTRDGGPNTTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 978 - protein, 627 aa, Artificial Sequence
  Recombinant HIV protein
AENLWVTVYYGVPVWKEAKTTLFCASEAKAYEKEVHNVWATHACVPTDPNPQEMVLENVTENFNMWKNDMVNQMHEDIISLWDQSLKPCVKLTPLCVTLNCTNANGTNNNGTVNVNDTMYGEIKNCSFNMTTELRDKKKQVYALFYKLDIVSLNENSNNSSEYRLINCNTSVCTQACPKVTFDPIPIHYCAPAGYAILKCNNKTFTGIGPCKNVSTVQCTHGIKPVVSTQLLLNGSLAEEEIIVRSENLTDNVKTIIVHLNESVEIVCTRPNNNTRKSVRIGPGQTFYATGAIIGDIRQAHCNISTIKWNKTLQGVEKKLKEHFPNKTIEFKPSSGGDLEITTHSFNCRGEFFCCNTSNLFTSNLFTDNLTNTTNITLPCRIKQIINMWQGVGRCMYAPPIAGNITCKSNITGLLLTRDGGENNRTETFRPGGGDMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 979 - protein, 647 aa, Artificial Sequence
  Recombinant HIV protein
AENLWVTVYYGVPVWKEATTTLFCASDAKSYEAEAHNIWATHACVPTDPNPREIKLENVTEHFNMWKNNMVEQMHKDIISLWDQSLKPCVKLTPLCVTLNCTDVKNETIAKTFNKNKTMKNETMKNLNDTIKNLNETMTNCSFRVTTELRDKEKQVHALFYRLDVVKTDGGNNSYRLINCNTSVCTQACPKITFEPIPIHYCAPAGFAILKCNNKTFNGTGPCKNVSTVQCTHGIKPVVSTQLLLNGSLAEEETIIRSENITNNAKTIIVQLNESVTINCTRPSNNTRQSIRIGPGQAFYTTEVIGNIRLAFCEINGTEWNKTLQQVAKKLGNLFSNKTIIFKPSSGGDLEITTHSFNCRGEFFYCNTSKLFNSTWDNDTWSDTTNSTGGNASKIILPCRIKQIINMWQEVGKCMYAPPIRGAINCLSNVTGLLLTRDGGNTNSTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 980 - protein, 646 aa, Artificial Sequence
  Recombinant HIV protein
AENLWVTVYYGVPVWKEATTTLFCASDAKAYNTEVHNVWATHACVPTDPNPQEVGLENVTENFNMWKNNMVEQMHEDIISLWDQSLKPCVKLTPLCVTLNCSDLRNATNTTNPTVSSRVIKKEMMGEVKNCSFNVTTDIRDRMQKVYALFYRPDVVPIQDHTIENNNTIENNTTYRLISCNTSVCTQACPKISFEPIPIHYCTPAGFAILKCNDKKFNGSGPCTNVSTVQCTHGIRPVVSTQLLLNGSRAEEEVIIRSENFTNNAKTIIVQLNKTVEINCTRPNNNTRKSISIGPGRAFYATGDIIGDIRQAHCNLSRAEWNKTLKYISTKLREQFGNKTIIFNGSSGGDPEIVTHSFNCGGEFFYCNTTKLFNSTWDANGNCTGCDESDGNNTITLPCRIKQIVNMWQEVGKCMYAPPIKGLIKCTSNITGLLLTRDGGANNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 981 - protein, 621 aa, Artificial Sequence
  Recombinant HIV protein
AENLWVTVYYGVPVWKDAETTLFCASDAKAYSTEKHNIWATHACVPTDPNPQEIHLENVTEEFNMWKNNMVEQMHTDIISLWDQSLRPCVKLTPLCVTLNCTNVNNNTTNVNNNTGWDEERKNCSFNITTELRDKRQKVYSLFYKLDVVQIDNSSYRLINCNTSACTQACPKVTFEPIPIHYCAPAGFAILKCKDEKFNGTGPCKNVSTVQCTHGIKPVVSTQLLLNGSLAEKEVMIRSENFTNNAKNILVQFKEPVKINCTRPDNNTRTSIRIGPGQAFYATGIIGDIRQAYCTVNGSEWNKALQKVVEQLRSSFENKTIIFANSSGGDLEITTHSFNCGGEFFYCNTSGLFDSTWNDTDSRQENGTITLPCRIKQIINMWQRTGQCIYAPPIQGAIRCVSNITGLILTRDGGNNNSTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 982 - protein, 627 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNVTSVNTTGDREGLKNCSFNMTTELRDKRQKVYSLFYRLDIVPINENQGSEYRLINCNTSACTQACPKVSFEPIPIHYCTPAGFAILKCKDEGFNGTGLCKNVSTVQCTHGIKPVVSTQLLLNGSLAEKNITIRSENITNNAKIIIVQLVQPVTIKCIRPNNNTRKSIRIGPGQAFYATGDIIGDIRQAHCNVTRSRWNKTLQEVAEKLRTYFGNKTIIFANSSGGDLEITTHSFNCGGEFFYCNTSGLFNSTWYVNSTWNDTDSTQESNDTITLPCRIKQIINMWQRAGQCMYAPPIPGVIKCESNITGLLLTRDGGKDNNVNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 983 - protein, 622 aa, Artificial Sequence
  Recombinant HIV protein
AENLWVTVYYGVPVWKDAETTLFCASNAKAYGTEVNIWATHACVPTDPNPQEINLENVTEEFNMWKNNMVEQMHTDIISLWDQGLKPCVKLTPLCVTLDCYNVTKSDKITKDMQEEIKNCSFNITTELRDKKQKVHSLFYRLDVVPMGGKNDSQYRLINCNTSACTQACPKVTFEPIPIHYCAPAGFAILKCNDKEFSGTGPCKNVSSVQCTHGIRPVVSTQLLLNGSLAEEKVRIRSEDITNNGKNIIVQLKTPVNISCTRPNNNTRKSVRIGPGQAFYATDDIIGNIRQAYCTVNRTQWDYTLQEVANQLRIYFNKTIIFNNSAGGDLEITTHSFNCGGEFFYCDTSGLFNSTWTWNDTVSWQGSDNITLQCRIKQIINMWQRAGQCIYAPPIQGVIRCDSNITGLILTRDGGNNSSPNEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 984 - protein, 640 aa, Artificial Sequence
  Recombinant HIV protein
AENLWVTVYYGVPVWKDAETTLFCASDAKAYETEKHNVWATHACVPTDPNPQEIRLENVTEDFNMWKNSMVEQMNEDIISLWDQSLKPCVKLTPLCVTLNCTDWTNNATSTNQTTPATSEETGVKNCSFNITTELRDKKQKVYSLFYKLDVVQISENNSSNSSNFTQYRLINCNTSACTQACPKVSFEPIPIHYCAPAGFAILKCNDSVFNGTGPCKNVSTVQCTHGIKPVVSTQLLNGSLAERKVMIRSENITNNAKNIIVQFTKPVNITCIRPGNNTRKSVRIGPGQAFYATGDITGDIRNAHCVVNRTEWNNTLQKVVEQLREYFPNKTIIFTNSSGGDIEITTHSFNCGGEFFYCNTSKLFNSRWENNGTANMLKNDTGSNETTLILRCRIKQIINMWQRVGQCMYAPPIQGVINCTSNITGLILTRDGGGENDTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 985 - protein, 632 aa, Artificial Sequence
  Recombinant HIV protein
AENLWVTVYYGVPVWRDAETTLFCASDAKAYDREAHNVWATHACVPTDPSPQEVPLGNVTEEFNMWKNNMVEQMHTDIISLWDQSLQPCVKLTPLCVTLNCSNSNNIPSVSNITDDMKEEIKNCSFNMTTELKDKKQNVYSLFYRLDVVPLETKTNQNSSHSRYRLINCNTSACTQACPKVSFEPIPIHYCAPAGFAILKCNDKGFNGTGLCKNVSTVQCTHGIKPVVSTQLLLNGSLAEGKVMVRSENITNNAKNIIIQFNNSVQINCTRPGNNTRKSIHLGPGKVFYATDIIGDIRKAHCNVNRQQWNKTLQDVATQLRTHFRNRTIIFNNSLGGDLEITTHSFNCRGEFFYCNTSGLFNGIWNGTQEPNRTESNDTITLQCRIKQIINMWQRVGQCIYAPPIQGEIRCESNITGLILTRDGGIINSTEETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 986 - protein, 639 aa, Artificial Sequence
  Recombinant HIV protein
AENLWVTVYYGVPVWRDAETTLFCASDAKAYDREAHNVWATHACVPTDPSPQEVPLGNVTEEFNMWKNNMVEQMHTDIISLWDQSLQPCVKLTPLCVTLNCSNINNIPNVNASSIPKDVKEEIKNCSFNMTTELKDKKQNVYSLFYRLDVVPLETNLKQNSSHSRYRLINCNTSACTQACPKVSFEPIPIHYCAPAGFAILKCNDKEFNGTGLCKNVSTVQCTHGIKPVVSTQLLLNGSLAEGKVMVRSENITNNAKNIIVQFNNSVQINCIRPGNNTRKSIHLGPGKVFYATNIIGDIRKAHCNVNRQQWNKALQDVATQLRTHFRNRTIIFNNSLGGDLEITTHSFNCRGEFFYCNTSGLFNSTWMLNSTLNNTWQELNSTNITLQCRIKQIINMWQRVGQCIYAPPIQGEISCESNITGLILTRDGGIINSTDTDEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 987 - protein, 626 aa, Artificial Sequence
  Recombinant HIV protein
AENLWVTVYYGVPVWKEAETTLFCASDAKAYETEKHNVWATHACVPTDPNPQEIHLENVTEEFNMWKNNMVEQMHTDIISLWDQSLKPCVKLTPLCVTLDCNNVTNNGTSDMREEIKNCSFNMTTELRDKRQKVYSLFYKLDIVQINEDQGNSSNNKYRLITCNTSACTQACPKVTFEPIPIHYCAPAGFAILKCKDEEFNGIGPCKNVSTVQCTHGIKPVVSTQLLLNGSLAEKEVKIRCENITNNAKTIIVQLVNPVKINCTRPNNNTRKSIHIGPGQAFYATGDIIGDIRQAHCNVNRTEWNNTLHQVVEQLRKHFNKTINFANSTGGDLEITTHSFNCGGEFFYCNTTNLFNSTWNHTASMNSTESNDTIILPCRIKQIINMWQRVGQCMYAPPIRGVIRCESNITGLILTRDGGNTNSTRETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 988 - protein, 641 aa, Artificial Sequence
  Recombinant HIV protein
AENLWVTVYYGVPVWKEATTTLFCASDAKAYVTEKHNVWATHACVPTDPNPQEVVLENVTENFNMWKNNMVEQMHEDIISLWEQSLKPCVKLTPLCVTLNCTDKLRNDTSGTNSSSWEKVQKGEIKNCSFNITTGIRGRVQEYSLFYKLDVIPIDSRNNSNNSTEFSSYRLISCNTSVCTQACPKISFEPIPIHYCAPAGFAILKCNDKKFNGTGPCKNVSTVQCTHGIKPVVSTQLLLNGSLAEEEVVIRSENFTNNVKSIIVQLNKSVVINCTRPNNNTRKSIHIGAGKALYTGEIIGDIRQAHCNLSRAQWNNTLKQIVIKLREQFGNKTIVFNQSSGGDVEIVMHSFNCGGEFFYCNSTQLFNSTWNGNDTWNDTWKDTTNDNITLPCRIKQIVNMWQKVGKCMYAPPIRGQIRCSSKITGLILTRDGGTNGTNETETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 989 - protein, 648 aa, Artificial Sequence
  Recombinant HIV protein
AENLWVTVYYGVPVWKEATTTLFCASDAKAYETEKHNVWATHACVPTDPNPQEVVLGNVTENFNMWKNNMVEQMHEDIISLWDESLKPCVKLTPLCVTLNCTDEVKTSYANKTSNETYKTSNETFGEIKNCSFSVPTGIKDKVQNVYALFYKLDVIPIDDNNNSSKNNNGSYSSYRLINCNTSVCTQACPKVSFEPIPIHYCAPAGFAILKCNNKTFNGTGPCTNVSTVQCTHGIRPVVSTQLLLNGSLAEEEVVIRSENFTNNAKTIIVHLKKSVEINCTRPGNNTRKSIHIGPGRAFYATGDIIGDIRQAHCNLSSVQWNDTLKQIVIKLGEQFGTNKTIAFNQSSGGDPEIVMHSFNCGGEFFYCNTTQLFNSTWEFHGNWTRSNFTESNSTTITLPCRIKQIVNMWQEVGKCMYAPPIRGQIRCSSNITGLLLTRDGGVNGTRETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 990 - protein, 634 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 991 - protein, 647 aa, Artificial Sequence
  Recombinant HIV protein
AENLWVTVYYGVPVWRDADTTLFCASDAKAHETEVHNVWATHACVPTDPNPQEIHLANVTENFNMWKNNMAEQMQEDVISLWDQSLKPCVKLTPLCVTLNCTKANFTKANSTNTSTNVSSTTGNITEEVRIENRTEEVRNCSFNMTTELRDKQQKVYALFYKLDLAQIGDKNSSNYRLINCNTSVCKQACPKISFDPIPIHYCTPAGYAILKCNDKNFNGTGPCKNVSSVQCTHGIKPVVSTQLLLNGSLAEEEIIIRSENLTNNAKTIIVHLNKSVEIKCTRPFNNTRTSVTIGPGQVFYKTGDIIGDIRRAYCEINRTEWNTTLKQVTKKLEKEFKNKTIIFQPPSGGDLEITMHHFNCRGEFFYCNTSHLFNSTWWMGNETREGCNSTNCTIILPCKIKQIINLWQKVGQCMYAPPIRGNISCVSNITGILLTRDGGVNNSTNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 992 - protein, 639 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 993 - protein, 635 aa, Artificial Sequence
  Recombinant HIV protein
AENLWVTVYYGVPVWRDADTTLFCASDAKAHVTEVHNVWATHACVPTDPNPQEIYLENVTEYFNMWKNNMAEQMQEDVISLWDQSLKPCVRLTPLCVTLHCTYANLTNVTNTAKGSDIIGNITDEVRNCSFNMTTELKDKKQKIYALFYKLDIVQVNKSSSEYRLINCNTSVCKQACPKISFDPIPIHYCTPAGYAILKCNDKNFNGTGECNNVSSVQCTHGIKPVVSTQLLLNGSLAEDEIVIRSENITNNAKTIIVHLNKSVEIKCIRPSNNTRTSMTIGPGQVFYRTGDIIGDIRQAYCEINQTKWNETLKQVAGKLKEHFNKTIIFRPPSGGDLEITMHHFNCRGEFFYCNTTQLFNSTWIGNETIGNETMKGGNNGTITLPCRIKQIINMWQGVGQCMYAPPISGNISCASNITGILLTRDGGDDGATNETFRPVGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 994 - protein, 636 aa, Artificial Sequence
  Recombinant HIV protein
AENLWVTVYYGVPVWKEATTTLFCASDAKAYDQEIHNIWATHACVPTDPNPQEVELKNVTENFNMWKSNMVEQMHEDIISLWDQSLKPCVKLTPLCVTLKCTDLNVTNSNSTDHSTNSSLEAKGEIKNCSFNITTTPRDKIQKEYAIFYKQDVVPIKNDNISYRLISCNTSVCTQACPKVTFEPIPIHYCAPAGFAILKCNDKGFNGTGPCTNVSTVQCTHGIRPAISTQLLLNGSLAEDKVVIRSENFTDNAKIIIVHLNETVKINCTRPNNNTRKSIHIAPGRAFYATGEIIGDIRKAYCTINESEWNNTLQKIVVTLREQFRNKTIVFNQSSGGDPEVTMHTFNCGGEFFYCNTAQLFNSSWDTNTNGNDTQGPSENNTIILPCRIKQIINMWQRVGKCIYAPPISGQIRCLSNITGLILTRDGGNSSLSSPEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 995 - protein, 635 aa, Artificial Sequence
  Recombinant HIV protein
AENLWVTVYYGVPVWKEANTTLFCASDAKAYDTEAHNVWATHACVPTDPNPQEVVLENVTENFNMWKNHMVEQMHEDIISLWDQSLKPCVKLTPLCVTLNCTDLVNSNITRVDNTTEKEMKNCSFNVTSGIRDKVQKEYALLYKLDIVQIDNDNTSHRDNTSYRLISCNTSVCTQACPKISFEPIPIHFCAPAGFAILKCNDKKFNGTGPCTNVSTVQCTHGIRPVVSTQLLLNGSLAEEEVVIRSENFTNNVKNIIVQLNESVQINCTRHNNNTRKSINIGPGRAFYATGKIIGDIRQAHCNISREKWQNTLKQIVKKLREQFKNKTIAFAPSSGGDPEIVMHSFNCNGEFFYCNTTKLFTSTWNSTWNSTWNNTEGSNSTVITLPCRIRQIINMWQEVGKCMYAPPIQGQIKCSSNITGLLLTRDGGVDTTKETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 996 - protein, 620 aa, Artificial Sequence
  Recombinant HIV protein
AENLWVTVYYGVPVWKDAETTLFCASDAKAYDTEVHNVWATHACVPTDPNPQEIHLENVTEDFNMWKNNMVEQMHTDIISLWDQSLKPCVKLTPLCVTLDCNATASNVTNEMRNCSFNITTELKDKKQQVYSLFYKLDVVQINEKNETDKYRLINCNTSACTQACPKVSFEPIPIHYCAPAGFAVLKCKDTEFNGTGPCKNVSTVQCTHGIRPVISTQLLLNGSLAEEGIQIRSENITNNAKTIIVQLDKAVKINCTRPNNNTRKGVRIGPGQAFYATGGIIGDIRQAHCNVSRAKWNDTLRGVAKKLREHFKNKTIIFEKSSGGDIEITTHSFNCGGEFFYCSTSGLFNSTWESNSTESNNTTSNDTITLTCRIKQIINMWQKVGQCMYAPPIQGVIRCESNITGLLLTRDGGNNSTNEIFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 997 - protein, 634 aa, Artificial Sequence
  Recombinant HIV protein
AENLWVTVYYGVPVWKEATTTLFCASDAKAYETEKHNVWATHACVPTDPDPQEVVLGNVTENFNMWKNNMVEQMHEDIISLWDQSLKPCVKLTPLCVTLNCTDELRNGTYANVTVTEKGEIKNCSFNITTAIRDKVQKTYALFYRLDVVPIDNNHGNSSSNYSNYRLINCNTSVCTQACPKVSFEPIPIHYCAPAGFAILKCNNKKFNGTGPCKNVSTVQCTHGIRPVVSTQLLLNGSLAEEEVVIRSENFTDNAKTIIVQLNDSVIINCTRPNNNTRKGITIGPGRVFYTGEIVGDIRQVHCNLSSAKWNSTLKQVVTKLREQFGNKTIVFNQSSGGDPEIVMHSFNCGGEFFFCNTTQLFNSTWNINGTWHGTTVSNKTIILPCRIKQIINMWQEVGKCMYAPPIRGQIRCSSNITGLLLTRDGGNNNSTTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 998 - protein, 628 aa, Artificial Sequence
  Recombinant HIV protein
AENLWVTVYYGVPVWKEATTTLFCASDAKAYDTEVHNVWATHACVPTDPNPQEIVLENVTENFNMWKNNMVEQMHEDIISLWDQSLKPCVKLTPLCVTLHCTNLKNATNTKSSNWKEMDRGEIKNCSFKVTTSIRNKMQKEYALFYKLDVVPIDNDNTSYKLINCNTSVCTQACPKVSFEPIPIHYCAPAGFAILKCNDKKFNGSGPCTNVSTVQCTHGIRPVVSTQLLLNGSLAEEGVVIRSENFTDNAKTIIVQLKESVEINCTRPNNNTRKSITIGPGRAFYATGDIIGDIRQAHCNISGEKWNNTLKQIVTKLQAQFGNKTIVFKQSSGGDPEIVMHSFNCGGEFFYCNSTQLFNSTWNNTIGPNNTNGTITLPCRIKQIINRWQEVGKCMYAPPIRGQIRCSSNITGLLLTRDGGKEISNTTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 999 - protein, 615 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDQSLKPCVKLTPLCVTLNCTNASVNATYNGEMKNCSFNATTAIRDKKQQVRALFYSLDIVPLEGNNSSYRLISCNTSACTQACPKVSFDPIPIHYCTPAGYAILKCNDEKFNGTGPCHNVSTVQCTHGIKPVVSTQLLLNGSLAEKEIIIRSENLTNNAKTIIVHLNKAVEIVCVRPNNNTRKSIRIGPGQTFYANDIIGDIRQAHCNISESKWNDTLRQVGAKLAEHFNNNTIRFEPSSGGDLEITTHSFNCRGEFFYCNTSGLFNGTYNHTDTGGNSTNITLPCRIKQIINMWQEVGRCIYAPPVEGNIICISNITGLLLLRDGGHNSTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1000 - protein, 631 aa, Artificial Sequence
  Recombinant HIV protein
AENLWVTVYYGVPVWKEATTTLFCASDAKAYDTEKHNVWATHACVPTDPNPQEIVLKNVTENFNMWKNNMVEQMHEDIISLWDQSLKPCVKLTPLCVTLNCTDYFGNTTNNSSREAMMKKCSFNITTNIRDKGQKEYALFYKTDVVPIDNDNTSYRMISCNTSVCTQACPKISFEPIPIHFCAPAGFAILKCFNKTFNGTGPCTNVSTVQCTHGIRPVVSTQLLLNGSLAEEEVVIRSENLTDNTKIIIVQLNKSVVINCTRPNNNTRKSIHIGPGRAFYATGGVIGDIRQAHCNISRKDWYEALQQIAIKLREQFENRTIAFNRSSGGDPEIVTHSFNCAGEFFYCNTTQLFNNTWNGTGWSDNSENTTGNGTITLPCRIKQIVNLWQEVGKCMYAPPIRGLIRCSSNITGLLLTRDGGNNTTTNGTQTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1001 - protein, 630 aa, Artificial Sequence
  Recombinant HIV protein
AENLWVTVYYGVPVWREADTTLFCASDAKGYDTEAHNVWATHACVPTDPRPQEMYLENVTENFNMWKNSMVEQMHTDIISLWDESLKPCVKLTPLCVTLDCQAFNSSSHTNSSIAMQEMKNCSFNVTTELRDKKKKEYSFFYKTDIEQINKNGRQYRLINCNTSACTQACPKVSFEPIPIHFCAPAGFAILKCNEKHFNGKGPCKNVSTVQCTHGIKPVVSTQLLLNGSLAEEEVVIRVENTIDNAKTIIVQLAKPVKINCTRPNNNTRKSIRIGPGQTFYATGDIIGNIRKAYCNVSKREWNNTLQQVAAQLSKSFNNTKIVFEKHSGGDLEVITHSFVCGGEFFYCNTSGLFNSTWTNSTWTNSTTGSNGTESNDTITLQCEIKQFINMWQRVGRCMYAPPIPGVIRCESDITGLLLTRDGPNSTQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1002 - protein, 640 aa, Artificial Sequence
  Recombinant HIV protein
AENLWVTVYYGVPVWKDAETTLFCASDAKAYDTEVHNVWATHACVPTDPDPQEMYLENVTENFNMWKNNMVEQMHEDIISLWDQSLKPCVKLTPLCVTLLCKDVNNSTNKTTIYKEMNGEIKNCSFNMTTELKDKTKKMYALFNRYDVVQISEQNNSQSDNSTDREYMLTSCNASTCTQACPKVTFEPIPIHYCAPAGFAILKCRDKGFNGTGPCKNVSTVQCTHGIKPAVSTQLLLNGSLAEENITIRSENITNNAKTIIIQLKKPVNITCIRPGNNTRKSVRIGPGQTFYATGDIIGDIRQAHCNVSRGKWNNTLNQVATQLRKYFNNNTAIIFTNSSGGDSEITTFSFNCAGEFFYCNTSGLFNSTWYSNSTNSSNHTNGTDDITLQCRIKQIVNMWQRVGQCMYAPPIRGEIRCESNITGILLTRDGGNNGSKANETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1003 - protein, 636 aa, Artificial Sequence
  Recombinant HIV protein
AENLWVTVYYGVPVWKDAVTTLFCASDAKAYSTEVHNVWATHACVPTDPNPQEMPLENVTENFNVWKNDMVEQMHEDIINLWDQSLKPCVKLTPLCVTLNCSNFSGDNSTNTSVSDDMQGEIKNCSFNVTTGLKDKKQKMDALFHRRDVVQISNGNNSYYMLISCNTSTCAQACPKITFEPIPIHYCAPAGFAILKCKDKGFNGTGSCKNVSTVQCTHGIKPVVTTQLLLNGSTAEEEIVIRSENITDNARTIIVQLTKPINITCIRPGNNTRKSVRIGPGQTFYATGAIIGNIRQAHCNVSKTEWNDTLRQVAEQLSKHFPNATTITFANASGGDLEITTHSFNCGGEFFYCNTSKLFSSTWDNSTWGNNTWGNSTGDNNETITLQCKIKQIINMWQQVGRCMYAPPIQGEIRCESNITGLLLTRDGGANSSTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1004 - protein, 637 aa, Artificial Sequence
  Recombinant HIV protein
AENLWVTVYYGVPVWRDAETTLFCASDAKAYETEAHNVWATHACVPTDPSPQEIHLENVTEKFNMWKNNMVEQMHIDIISLWDQSLKPCVKLTPLCVTLNCVNSNFTNNSSNSSNNSNIDMQEEIKNCSFNMTTELRDKRRQIHSLFYKLDVVQINENNSQQYRPINCNTSACTQACPKMSFEPIPIHYCAPAGFAILKCNNKEFNGTGPCNNVSTVQCTHGIKPVVSTQLLLNGSLAEEKVIIRSENITNNAKTIIVQLAESVSITCTRPANNTIRGERIGPGQTFYTRDTIIGDIRQAHCNVSKDWNNTLQQVATQLGKYFNNKTIIFANHSGGDIEITTHSFNCGGEFFYCNTSKLFDSIWNRTNGSNYTRLGDDTETNDPITLQCRIKQIVRMWQTVGQCMYAPPIRGEIKCESNITGLLLTRDGGNNNSMNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1005 - protein, 646 aa, Artificial Sequence
  Recombinant HIV protein
AENLWVTVYYGVPVWRDAETTLFCASDAKAYDAEAHNIWATHACVPTDPSPQEIHIKNVTENYNMWKNNMVEQMHIDIISLWDQSLKPCVQLTPLCVTLNCSNYNGSSTSNSTSPPPATSFNDTSMIGEIKNCSYNMTTELRDKKKKVYSLFYKLDVVPLSNDSSNTQYRLINCNSSTCTQACPKVSFEPIPIHFCAPAGFAILKCNEKNFNGTGPCRDVSTVQCTHGIKPVVSTQLLLNGSLAEGEVVIRSENISNNAKNIIVQLFKPVNITCIRPNNNTRKSIHIGPGQAFYAWGDITGDIRQAHCKVNKTEWEEALQKVATKFMKYFTNKTINFANASGGDLEITTHTFNCGGEFFYCSTSNLFNSTCTNNNGTANCTNTNGTALNETITLQCRIKQIVRMWQRVGQCMYAPPIQGVIRCESNITGIILTRDGGDSNDTNGNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1006 - protein, 656 aa, Artificial Sequence
  Recombinant HIV protein
AENLWVTVYYGVPVWKDAETTLFCASDAKGYEREAHNIWATHACVPTDPNPQELHLENVTEDFNMWKNTMVEQMHEDIISLWDQSLKPCVKITPLCVTLNCIDASFNSSNSSLNNSSNSSLNNSSLNSSSNIGEMQMKNCSFNVTTELRDKQKKEYALFYRQDIVQINENKNNSNQSKENNSSQSHYMLINCNTSTCAQACPKVSFQPIPIHYCAPAGFAILKCNDKGFSGTGKCKNVSTVQCTHGIKPVVTTQLLLNGSTAEGNVTIRSENITNNAKTIIVQLVKPVKINCTRPGNNTRKSVHIGPGQALYATGNIVGDIRQAHCNVSGKEWNDTLSQVVTQLRKYFNNTIIKFNSSSGGDVEITTHSFNCGGEFFYCDTSSLFNSTWENNTNSNWDNSTITLQCRIKQFINMWQRVGRCMYAPPIPGVIRCESNITGILLTRDGGVNNDTNTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1007 - protein, 650 aa, Artificial Sequence
  Recombinant HIV protein
AENLWVTVYYGVPVWRDAETTLFCASDAKAYDTEAHNVWATHACVPTDPNPQEIHLKNVTENFNMWKNAMVEQMNEDIISLWDQSLKPCVKLTPLCVTLHCHNFTSSSNSSNSTVSPQMRGEIQNCSFNTTTLLKDKKKKEYALFYRQDIVPLDTNGTNIDTNGTNSSQYMLINCNTSTCAQACPKITFEPIPIHYCAPAGFAILKCRDKEFNGTGTCKNVSTVQCTHGIKPVVSTQLLLNGSTAEEGIVIRSKNISANAKTIIVQLDEPVRINCTRPGNNTRKSVHLGPGQAFYATGDIIGDIRQAYCNVSGTEWNKTLHRVATKLKGYFKSNTTIIFTKPSGGDLEITTHSFNCGGEFFYCNTSNLFNGTLYKNNTWMFNGTLYNNTNESSTSGTITIKCRIKQIINMWQTVGQCMYAPPIPGEIRCESNITGLLLTRDGEGDEKANETFRPIGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1008 - protein, 628 aa, Artificial Sequence
  Recombinant HIV protein
AENLWVTVYYGVPVWKDADTTLFCASDAKAYDKEVHNVWATHACVPTDPNPQEIKLTNVTENFNMWKNHMVEQMHTDIISLWDQSLKPCVKLTPLCVTLNCTNATTNGTIEDGAKNCSFNMTTELRDKQKKVYSLFYKLDIVKIRENNNSDNYTYRLINCNTSTCTQACPKVTFEPIPIHYCAPAGFAILKCTDKKFNGTGPCSNVSSVQCTHGIKPVVSTQLLLNGSLAEEGIIIRSEDITNNAKTIIVQLTKPVNITCVRPNNNTRRGIHIGPGQAFYARDSIIGDIRQAYCNVSKAEWNETLQQVAKKLRDNYGNKTIIFTSSSGGDLEITTHSFNCGGEFFYCNTSSLFNSTWNWNGTSIQGPNDTQSNGTITLPCRIKQIVNMWQRAGQCMYAPPIPGIIKCESNITGLLLVRDGGNNSGSNETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1009 - protein, 630 aa, Artificial Sequence
  Recombinant HIV protein
AENLWVTVYYGVPVWREADTTLFCASDAKAYSTEVHNVWATHACVPTDPDPQEILLKNVTEDFNMWKNNMVEQMHADIINLWDQSLKPCVKLTPLCVTMQCTDMTNISIKLASIANTSIAEEMQGEIKNCSFNVTELRNKRKKEYAFFYKQDIVQINNNESMLISCNTSTCTQACPKVSFEPIPIHFCAPAGFAILKCNDKKFNGTGPCENVSTVQCTHGIKPVVSTQLLLNGSLAEEEVVIRSENITNNAKTIIVQLDKPVNITCVRPNNNTIKSVRIGPGQAFYTAGQVIGDIRKAYCEVNRTEWKSALNQVASKLRENFQNASTIKFNEHSGGDIEITTHMFNCKGEFFYCNTSSLFNYTFSNSTEDNNPSNATITLQCRIRQVVNMWQRVGLCMYAPPIKGKLRCESNITGLLLTRDGGNNNNATETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1010 - protein, 631 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1011 - protein, 630 aa, Artificial Sequence
  Recombinant HIV protein
AENLWVTVYYGVPVWKDADTTLFCASDAKAHETEVHNVWATHACVPTDPNPQEIHLENVTENFNMWKNKMVEQMQEDVISLWDQSLKPCVKLTPLCVTLTCTNATLNCTNLTNGNKTTNVSNIIGNLTDEVRNCSFHMTTELRDKKQKVYALFYKLDIVQINSSEYRLINCNTSVCKQACPKISFDPIPIHYCTPAGYAILKCNDKNFNGTGPCKNVSSVQCTHGIKPVVSTQLLLNGSLAEEEIIISSENLTNNAKTIIVHLNKSVEISCTRPSTNTRTSIRIGPGQVFYRTGDITGDIRKAYCEINETKWNEALKQVAGKLKEHFNKTIIFQPPSGGDLEITMHHFNCRGEFFYCDTTQLFNRTWGENETREGRNITLPCKIKQIVNMWQGAGQCMYAPPISGIIKCVSNITGILLTRDGGANNSASETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1012 - protein, 654 aa, Artificial Sequence
  Recombinant HIV protein
AENLWVTVYYGVPVWKEAVTTLFCASDAKAYDTEVHNVWATHACVPTDPDPQEVVLENVTENFNMWKNNMVEQMHEDIISLWDQSLKPCVKLTPLCVTLNCTDYNNTATNTTSSATTTASSANKTAKEEAVMKNCSFNITTNVRDKVKREYALFYNLDVVKLEEGETSYRLVSCNTSVCTQACPKITFEPIPIHYCAPAGFAILKCNNKTFNGTGPCTNVSTVQCTHGIKPVVSTQLLLNGSLAEGGEVMIRSANFTNNAKTIIVQLSKSVAINCTRPNNNTSKSIHMGPGGAFFATGRIIGDIRKAYCTVNGTEWNTTLRQIVEKFKKQFGENKTIVFKPSAGGDPEIVTHSFNCGGEFFYCNTTNLFNSSSTELNSTWSGNSNDTGKNDTITLPCRIKQIINMWQQVGKCMYAPPISGKINCLSNITGLLLTRDGGSDGGSKNSSKNETGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1013 - protein, 635 aa, Artificial Sequence
  Recombinant HIV protein
AENLWVTVYYGVPVWKEATTTLFCASDAKAYETEVHNVWATHACVPTDPNPQELVLENVTEYFDMWKNNMVEQMHEDIISLWDQSLKPCVKLTPLCVTLNCTDWTNGTDWNTTNSNNTTISKEETIEGGEMKNCSFNITTATGDKKKERAFFYKLDVAPIDNSNTSYRLISCNTSVCTQACPKISFEPIPIHYCAPAGFAILKCNDKKFNGTGSCTNVSTVQCTHGIRPVVSTQLLLNGSLAEEEVVIRSKNFSDNAKIIIVQLNESVPINCTRPHNNTRKSIHIGPGRAWYATGDIIGDIRKAYCNISEAKWNNTLKQITEKLKEQFNKTIIVFNQPSGGDPEVTMHSFNCGGEFFYCNTSKLFNGTWNSTKRANNTEGIIILQCRIKQIINRWQEVGKCMYAPPIEGQIKCSSNITGLLLTRDGGKTANNTTEFFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1014 - protein, 642 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1015 - protein, 645 aa, Artificial Sequence
  Recombinant HIV protein
AENLWVTVYYGVPVWREAKTTLFCASDAKAYETEVHNVWATHACVPTDPNPQEIVLGNVTENFNMWKNDMADQMHEDVISLWDQSLKPCVKLTPLCVTLNCTDTNVTGNRTVTGNSTNNKKGTGTNGTGIYNIEEMKNCSFNVTTELRNKKHKEYALFYRLDIVSLNNKPNEYRLINCNTSACTQACPKVSFDPIPIHYCAPAGYAILKCNNKTFNGTGPCYNVSTVQCTHGIRPVVSTQLLLNGSLAEGEIIIRSENLTENTKTIIVHLNESIEINCTRPNNNTRKSVRIGPGQAFYATNDVIGDIRQAHCNISTDRWNKTLQQVMKKLGEHFPNKTIQFKPHAGGDIEITMHSFNCRGEFFYCNTSNLFNSTYHSNNGTYKYNGNSSLPITLQCKIKQIVRMWQGVGQCMYAPPIAGNITCRSNIAGILLTRDGGFNTTNNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1016 - protein, 638 aa, Artificial Sequence
  Recombinant HIV protein
AENLWVTVYYGVPVWKEANAPLFCASDAKAYEKEVHNVWATHACVPTDPNPQELDLVNVTENFNMWKNDMVDQMHEDIISLWDESLKPCVKLTPLCVTLNCTNANINNDTVANSGTFKVDNSSNVVKNCSFNITTEIRDKKKKEYSLFYRLDILPLDNSSESKNYSEYVLINCNASTCTQACPKVSFDPIPIHYCAPAGYAILKCKDKTFNGTGPCSNVSTVLCTHGIKPVVSTQLLLNGSLAEEGIVIRSENLTNNAKTIIVQLNEPVEIMCVRPGNNTRKSVRIGPGQTFYATGDIIGDIRQAHCNISRSDWNKTLQEVGKKLREYFHNKTIRFKPAVVGGDLEITTHSFNCRGEFFYCNTSELFTGEYNGTEYKNTSNSNPNITLPCRIKQFVNMWQRVGRCMYAPPIEGNITCNSSITGLLLTWDGGNNTNGTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1017 - protein, 630 aa, Artificial Sequence
  Recombinant HIV protein
AENLWVTVYYGVPVWKDAKTTLFCASDAKAYEKEVHNVWATHACVPTDPNPQEIVLGNVTEDFNMWENDMVDQMHEDIISLWDQSLKPCVKLTPLCVTLNCTNVNVTRGNNTQGYNTNSNNTDGGMRNCSFNITTELRDKKKKEYALFYKLDIVPLNVSTKEYRLINCNTSTCTQTCPKVSFDPIPIHYCAPAGYAILKCNNKTFTGTGPCLNVSTVQCTHGIKPVVSTQLLLNGSLAEEEIIIRSKNLTNNVNTIIVHLNESVEIVCTRPNNNTRKSIRIGPGQTFYATDIIGDIRQAYCNISKDDWNKTLQEVGRKLEEHFPNKTIEFKPSSGGDLEITTHSFNCRGEFFYCNTSGLFNSTYNSAYKSNDTTNSTITLPCRIKQIVNMWQEVGRCMYAPPIAGNITCKSNITGLLLVRDGGGESNETEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1018 - protein, 622 aa, Artificial Sequence
  Recombinant HIV protein
AENLWVTVYYGVPVWKEATTTLFCASDAKSYEAEAHNIWATHACVPTDPNPQEIVLENVTENFNIWKNNMVEQMHDDIISLWDQSIKPCVKLTPLCVTLNCTEWKNATTNATNEGIGMKNCSFTEVRDKKKQAYALFYKLDVVQMNDDNSTNTSYRLINCNASTCTQACPKISFEPIPIHYCAPAGFAILKCNDKKFNGTGPCKNVSTVQCTHGIKPVVSTQLLLNGSLAEEEIIIRSKNLTNNAKIIIVHLNESVPINCTRPYDKVSYRTPIGVGRASYTTRIKGDIRQAHCNISGEKWNKTLQQVAVKLRDLLNQTAIIFKPSSGGDPEITTHSFNCGGEFFYCNTSGLFNNSVWTSNSTIGANGTITLPCRIKQIINMWQGVGKCMYAPPIEGQINCSSTITGLLLTRDGGVKNNSQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1019 - protein, 631 aa, Artificial Sequence
  Recombinant HIV protein
AENLWVTVYYGVPVWKEATTTLFCASDAKAYKAEAHNIWATHACVPTDPNPREIQLENVTENFNMWKNNMVEQMHEDVISLWDQSLKPCVKLTPLCVTLNCIEWKNENETKGNKTVDPDKDIGMKNCSFNVTTEVRDKKKQVYALFYKLDVVQMNDNNTNTSYRLINCNTSACTQECPKVTFEPIPIHYCAPAGFAILKCNNKMFNGTGPCNNVSTVQCTHGIRPVVSTQLLLNGSLAEEEIIIRSENITNNAKIIIVHLNESVVINCTRPYNNIRQRTPIGLGQALYTTRRIEDIRRAHCNISEAAWKKTLEQVAKKLKVLFNRTTIDFKPSSGGDPEITTHSFNCGGEFFYCNTSKLFNHSVGENNTLSISNGVNTNITLPCKIKQIVNMWQGVGKCMYAPPIQGLIRCSSNITGLLLTRDGGNTSQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1020 - protein, 631 aa, Artificial Sequence
  Recombinant HIV protein
AENLWVTVYYGVPVWKDAETTLFCASDAKAYDTEVHNVWATHACVPTDPNPQEIYMENVTEEFNMWKNNMVEQMHTDIISLWDQSLKPCVQLTPLCVTLDCSYNITNNITNSITNSSVNMREEIKNCSFNMTTELRDKNRKVYSLFYKLDVVQINNGNNSSNLYRLINCNTSACTQACPKVTFEPIPIRYCAPAGYAILKCNDKEFNGTGLCKNVSTVQCTHGIRPVVSTQLLLNGSLAEGKVMIRSENITNNVKNIIVQLNETVTINCTRPNNNTRKSVRIGPGQTFYATGDIIGDIRQAHCNVSGSQWNRALHQVVGQLREYWNTTIIFKNSSGGDLEITTHSFNCGGEFFYCNTSGLFNSNWTHNDTASMKPNDTITLPCRIKQIINMWQRVGQCIYAPPIQGVIRCESNITGLILTRDGGGNINESQIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1021 - protein, 630 aa, Artificial Sequence
  Recombinant HIV protein
AENLWVTVYYGVPVWREANTTLFCASDAKAYDTEVHNVWATHACVPTDPNPQEVVMGNVTEDFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTSVCTQACPKVSFEPIPIHYCAPAGFAILKCNNKTFNGKGPCRNVSTVQCTHGIKPVVSTQLLLNGSLAEEDIIIRSENFTNNGKNIIVQLKEPVKINCTRPGNNTRRSINIGPGRAFYATGAIIGDIRKAHCNISTEQWNNTLTQIVDKLREQFGNKTIIFNQSSGGDPEVVMHTFNCGGEFFYCNSTQLFNSTWFNNGTSTWNSTADNITLPCRIKQVINMWQEVGKCMYAPPIRGQIDCSSNITGLILTRDGGSNSSQNETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1022 - protein, 631 aa, Artificial Sequence
  Recombinant HIV protein
AENLWVTVYYGVPVWEDADTTLFCASDAKAYSTEKHNVWATHACVPTDPDPQEIPLENVTENFNMWKNNMVEQMHEDIISLWDESLKPCVMLTPLCVTLNCSAVNGTMNEQMKNCTFNITTEIRDKKKEEYALFYKLDIEQISKTANSTTANSNYSSYRLINCNVSTCKQACPKVTFEPIPIHYCAPAGFAILKCRDEDFNGTGPCKNVSTVQCTHGIKPVVSTQLLLNGSLAKGDIVIRSENLTNNAKVIIVQLNEPVQIVCIRPNNNTRRSIHLGPGRAFYATDIIGDIRQAHCNVTRGKWVNITKNVKEQLWKIFNKTTNITFNNTIFNSPAGGDLEITTHSFNCGGEFFYCNTSDLFNETNLSANHTDTNENITLQCRIKQIVRMWQRVGQCMYAPPIAGNITCISNITGLLLTRDGVNDTHDKENETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1023 - protein, 624 aa, Artificial Sequence
  Recombinant HIV protein
AENLWVTVYYGVPVWKEATTTLFCASDAKAYDTEVHNVWATHACVPTDPNPQEVKLENVTENFNMWKNNMVEQMHEDIISLWDQSLKPCVKLTPLCVTLNCTDLRNATNTTSSSWETMEKGEIKNCSFNITTSIRDKVQKEYALFYNLDVVPIDNASYRLISCNTSVCTQACPKVSFEPIPIHYCAPAGFAILKCNDKKFNGTGPCTNVSTVQCTHGIRPVVSTQLLLNGSLAEEEIVIRSENFTNNAKTIIVQLNESVVINCTRPNNNTRKSINIGPGRALYTTGEIIGDIRQAHCNLSKTQWENTLEQIAIKLKEQFGNNKTIIFNPSSGGDPEIVTHSFNCGGEFFYCNSTQLFTWNDTRKLNNTGRNITLPCRIKQIINMWQEVGKCMYAPPIRGQIRCSSNITGLLLTRDGGKDTNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1024 - protein, 621 aa, Artificial Sequence
  Recombinant HIV protein
AENLWVTVYYGVPVWTDAKTTLFCASDAKAYDREVHNVWATHACVPTDPNPQEIVLENVTENFNMWKNDMVDQMHEDIISLWDQSLKPCVKLTPLCVTLHCTNATFKNNVTNDMNKEIRNCSFNTTTEIRDKKQQGYALFYRPDIVLLKENRNNSNNSEYILINCNASTCTQACPKVNFDPIPIHYCAPAGYAILKCNNETFSGKGPCNNVSTVQCTHGIKPVVSTQLLLNGSLAEKEIIIRSENLTDNVKTIIVHLNKSVEIVCTRPNNNTRKSMRIGPGQTFYATGDIIGDIRQAYCNISESMWKETLERVKEKLKENYNNNKTIKFAPSSGGDLEITTHSFNCRGEFFYCNTSKLFSYNGTGNETIILPCRIKQIINMWQGVGRCMYAPPIAGNITCKSNITGLLLVRDGGEDNKTEETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1025 - protein, 630 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1026 - protein, 615 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLNCTSPAAHNESETRVKHCSFNITTDVKDRKQKVNATFYDLDIVPLSSSDNSSNSSLYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGDLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1027 - protein, 628 aa, Artificial Sequence
  Recombinant HIV protein
AENLWVTVYYGVPVWREAKTTLFCASDAKAYEKEVHNVWATHACVPTDPNPQELVLGNVTENFNMWENDMVDQMHEDIISLWDQSLKPCVKLTPLCVTLECKNATRSNQTTYYDNMDKEIKNCSFNVTTELTDKKKNMRALFYRADIEPLDGNSNESINSSEGDKYILINCNTSTCAQACPKVTFDPIPIHYCAPAGYAILKCNNKTFNGIGPCKNVSTVQCTHGIKPVVSTQLLLNGSLSEEGIIIRSKNLTDNTKTIIVHLNESVAIVCTRPNNNTRKSIRIGPGQTFYATGEVIGDIRQAHCNISGEQWNRTLERIKDKLTEYFPDKIIKFNHSSGGDLEITTHTFNCRGEFFYCNTSILFTENENSSDNITLPCRIKQFVNMWQEVGRCMYAPPIAGNITCNSSITGLLLTRDGGLNNKENGTETFRPQGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1028 - protein, 632 aa, Artificial Sequence
  Recombinant HIV protein
AENLWVTVYYGVPVWKEAKTTLFCASDAKAYEREVHNVWATHACVPTDPNPQEMALGNVTENFNMWKNDMVDQMHEDIISLWDQSLKPCVKLTPLCVTLNCSNVNSSNVYTPMNSTLKNITEEMKNCSFNITTELRDKRRKENALFYKLDITPINGESNSREYRLINCNTSTCTQACPKVSFDPIPIHYCAPAGYAILKCNNETFEGTGPCNNVSTVQCTHGIKPVVSTQLLLNGSLAKEEIVIRSENLTDNAKTIIVHLKESVEIVCTRPGNNTRKSVRIGPGQTFYATGEIIGDTRQAHCNISEEKWNKTLQKVSKILQEHFPNKAIKFEPHSGGDLEITTHSFNCRGEFFYCNTTKLFNGTYNSTANSTGSVSNTTITLPCRIKQIVNMWQGVGRCMYAPPIKGNITCKSIITGLLLTRDGGNDDNDTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1029 - protein, 652 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1030 - protein, 636 aa, Artificial Sequence
  Recombinant HIV protein
AENLWVTVYYGVPVWREAKTTLFCASDAKAYEKEVHNVWATHACVPTDPNPQELVLENVTENFNMWKNDMVNQMHEDIISLWDQSLKPCVKLTPLCVTLNCSNVNINETSIDFNVTSNISMKEEMKNCSFKVNSELRDKNRREHALFYKLDIVQLNDEGNDSYSYRLINCNTSTCKQACPKVSFEPIPIHYCAPAGYAILKCNNETFNGSGPCNNVSTVQCTHGIKPVVSTQLLLNGSLAEKEIMIRSENLTNNAKTIIVQLTEAVNITCMRPGNNTRRSVRIGPGQTFYATGEIIGDIRQAHCNISKDKWNQILQNVRAKLGEHFHDKTIKFEPSSGGDLEITTHSFNCGGEFFYCNTTNLFSRTYTNGSNSNVNITSATITLPCRIKQIINMWQEVGRCMYAPPIAGNITCISNITGLLLTRDGGNGNDTNDTETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1031 - protein, 609 aa, Artificial Sequence
  Recombinant HIV protein
AENLWVTVYYGVPVWKEAKATLFCASDAKAQETEVHNIWATHACVPTDPNPQEMILENVTENFNMWKNDMVDQMHEDVISLWDQSLKPCIKLTPLCVTLNCTNATYNGSTIEDVRNCSFNATTEVKNKKQEVNALFNLLDIVPIKSSIYRLTNCNTSACTQACPKVTFDPIPIHYCAPAGYAILKCNNKTFNGKGPCNNVSTVQCTHGIKPVVSTQLLLNGSLAEEDIIIRSENLTNNVKTIIVHLKEPVEIVCTRPGNNTRKSVRIGPGQTFYATGAIIGDIRKAHCNISKKAWNDTLHKVEGKLRELYNKSIKFEPSSGGDLEITTHSFNCRGEFFYCNTTKLFHEGSRKNDNDTITLPCRIKQFINMWQEVGRCMYAPPIAGNITCNSSITGILLVRDGGTNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1032 - protein, 616 aa, Artificial Sequence
  Recombinant HIV protein
AENLWVTVYYGVPVWREAKTTLFCASDAKAYETEAHSVWATHACVPTDPNPQEMVLENVTENFNMWKNDMVDQMHEDVISIWDQSLKPCVKLTPLCVTLDCSTYNNTHNISKEMKICSFNMTTELRDKKRKVNVLFYKLDLVPLTNSSNTTNYRLISCNTSTCTQACPKVSFDPIPIHYCAPAGYAILKCNNKTFNGTGPCNNVSTVQCTHGIKPVVSTQLLLNGSLAEEEIIIRFENLTDNVKIIIVQLNETINITCTRPNNNTRKSIRIGPGQSFYATGEIVGNIREAHCNISASKWNKTLERVRTKLKEHFPNKTIEFEPSSGGDLEITTHSFNCGGEFFYCNTSGLFNSAINGTLTSNVTLPCRIKQIINMWQEVGRCMYAPPIAGNITCKSNITGLLLTRDGGENSSSTTETFRPTGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1033 - protein, 629 aa, Artificial Sequence
  Recombinant HIV protein
AENLWVTVYYGVPVWREAKTTLFCASDAKAYEKEVHNVWVTHACVPTDPNPQEMNLENVTENFNMWKNDMVDQMHEDIISLWDQSLKPCVKLTPLCVTLNCNNVNVTHNSTYNNTEGEQIKNCSFNITTELRDKKQKVYALFYKLDILPLNGNNDSNEYRLINCNTSACTQACPKVSFDPIPIHYCAPAGYAILKCNNKTFNGKGPCNNVSTVQCTHGIKPVVSTQLLLNGSLAEKEIIIRSENITDNVKIIIVHLNESVEINCTRPNNNTRKSIRIGPGQTFYATGEIIGKIREAHCNISKEKWNKTLLRVAKKLREHFPGKAIKFEPSSGGDLEITTHSFNCRGEFFYCTTSKLFNSTYNPNDTESNSNNSNETLTLTCKIKQIINMWQGVGRCMYAPPIEGSITCNSTITGLLLTRDGGSKNNTEEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1034 - protein, 616 aa, Artificial Sequence; identical to SEQ ID NO: 766
  Recombinant HIV protein

SEQ ID NO: 1035 - protein, 621 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1036 - protein, 635 aa, Artificial Sequence
  Recombinant HIV protein
AENLWVTVYYGVPVWKDAETTLFCASDAKAHHAEAHNVWATHACVPTDPNPQEIHLENVTEKFNMWKNNMVEQMHTDIISLWDQSLKPCVKLTPLCVTLNCTNATYTNSDSKNSTSNSSLEDSGKGDMNCSFDVTTSIDKKKKTEYAIFDKLDVMNIGNGRYTLLNCNTSVCTQACPKMSFEPIPIHYCTPAGFAILKCNDNKFNGTGPCTNVSTIQCTHGIKPVVSTQLLLNGSLAEGGEVIIRSENLTDNAKTIIVQLKEPVEINCTRPNNNTRKSIHMGPGAAFYARGEVIGDIRQAHCNISRGRWNDTLKQIAKKLREQFNKTISFNQSSGGDLEIVMHTFNCGGEFFYCNTTQLFNSTWNENDTTWNNTAGSNNNETITLPCRIKQIINRWQEVGKCMYAPPISGPINCLSNITGLLLTRDGGDNNNTIETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1037 - protein, 634 aa, Artificial Sequence
  Recombinant HIV protein
AENLWVTVYYGVPVWKDAETTLFCASDAKAYDTEVHNVWATHACVPTDPNPQEIHLENVTENFNMWKNNMVEQMHTDIISLWDQSLKPCVKLTPLCVTLNCTDLRNATSRNVTNTTSSSRGMVGGGEMKNCSFNITTGIRGKVQKEYALFYELDIVPIDNKIDRYRLISCNTSVCTQACPKVSFEPIPIHYCAPAGFAILKCKDKKFNGKGPCSNVSTVQCTHGIRPVVSTQLLLNGSLAEEEVVIRSENFTNNAKTIIVQLNESVEINCTRPNNNTRKSINIGPGRAFYTTGEIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQEVGRCMYAPPIRGQIRCSSNITGLLLTRDGGPEDNKTEVFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1038 - protein, 650 aa, Artificial Sequence
  Recombinant HIV protein
AENLWVTVYYGVPVWKDAETTLFCASDAKAYETEVHNVWATHACVPTDPNPQEIHLENVTEDFNVWKNNMVEQMHTDIISLWDQSLKPCVKLTPLCVTLHCTDVNTTCITTNNSTMTNSSNSSTEGNCSSYNYNGREELRNCSFNITTSIQDKVQDYAIFYKLDIVPIKSDNSDNTSYRLINCNTSVCTQACPKISFEPIPIHYCAPAGFAILKCNDKKFSGKGTCNNVSTVQCTHGIRPVVSTQLLLNGSLAEEGVVLRSENFTNNAKTIIVQLKDPVKIECERPNNNTIKSIHLGPGRAWHATGQIIGDIRKAFCTLNSTNWTNTLKQMVEKLREQFENKTIAFNQSTGGDPEIVMHTFNCGGEFFYCNTTQLFNSIWYNTTNSSWNNKTWSNNTITLPCRIKQIINMWQQVGKCIYAPPIKGKIKCISNITGLLLTRDGGDTNNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1039 - protein, 633 aa, Artificial Sequence
  Recombinant HIV protein
AENLWVTVYYGVPVWKDAETTLFCASDAKGYEKEVHNVWATHACVPTDPNPQEIHLENVTENFNMWKNNMVEQMHTDIISLWDQSLKPCVKLTPLCVTLNCSDVNTTSVNTTASSMEGGEIKNCSFNTTTSMSDKMQKEYALFYTLDVVPIVKENNTYRLISCNTSVCTQACPKVSFEPIPIHYCAPAGFAILMCNNKTFDGKGPCNNVSTVQCTHGIKPVVSTQLLLNGSLAEEEVVIRSDNFTDNAKTIIVHLNESIEITCTRPNNNTSKSITIGPGRAFYATGRIIGDIRKAHCNISGEKWHNALEQIVKKLGEKFENATTIRFNQSSGGDQEIVMHTFNCGGEFFYCNSTQLFNSTWWPNGTTTEWSNETSNGTITLPCRIKQIINMWQEVGKCMYAPPISGPISCSSNITGLLLVRDGGNDNETNGTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1040 - protein, 631 aa, Artificial Sequence
  Recombinant HIV protein
AENLWVTVYYGVPVWKDAETTLFCASDAKAYEKEVHNVWATHACVPTDPNPQEIHLENVTENFNMWKNNMVEQMHTDIISLWDQSLKPCVKLTPLCVTLNCVTYNNSMNSSATYNNSMNGEIKNCSFNTTTELRDKKQKVYALFYRTDVVPLNNNNNNSEYILINCNTSTCTQACPKVSFDPIPIHYCAPAGFAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRCMYAPPIEGNITCNSNITGLLLTRDGGGNVTEINRTEIFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1041 - protein, 630 aa, Artificial Sequence
  Recombinant HIV protein
AENLWVTVYYGVPVWKDAETTLFCASDAKAYDKEVHNVWATHACVPTDPNPQEIHLENVTENFNMWKNNMVEQMHTDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGFAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1042 - protein, 629 aa, Artificial Sequence
  Recombinant HIV protein
AENLWVTVYYGVPVWKDAETTLFCASDAKAYDTEVHNVWATHACVPTDPNPQEIHLENVTEDFNMWKNNMVEQMQTDVINLWDQSLKPCVKLTPLCVTLNCKDVNATNTTSSSEGMMERGEIKNCSFNITKSIRNKVQKEYALFYKLDVVPIDNKNNTKYRLISCNTSVCTQACPKVSFEPIPIHYCAPAGFAILKCNNKTFNGKGQCKNVSTVQCTHGIRPVVSTQLLLNGSLAEEKVVIRSDNFTDNAKTIIVQLNESVKINCTRPSNNTRKSIHIGPGRAFYTTGEIIGDIRQAHCNISRAQWNNTLKQIVEKLREQFNNKTIVFTHSSGGDPEIVMHSFNCGGEFFYCNSTQLFNSTWNDTEKSSGTEGNDTIILPCRIKQIINMWQEVGKCMYAPPIKGQIRCSSNITGLLLTRDGGKNESEIEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1043 - protein, 628 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITTSIRDEVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1044 - protein, 631 aa, Artificial Sequence
  Recombinant HIV protein
AENLWVTVYYGVPVWKDAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1045 - protein, 646 aa, Artificial Sequence
  Recombinant HIV protein
AENLWVTVYYGVPVWKDAETTLFCASDAKAYNTEVHNVWATHACVPTDPNPQEIHLENVTENFNMWKNNMVEQMHTDIISLWDQSLKPCVKLTPLCVTLNCSDLRNATNTTNPTVSSRVIKKEMMGEVKNCSFNVTTDIRDRMQKVYALFYRPDVVPIQDHTIENNNTIENNTTYRLISCNTSVCTQACPKISFEPIPIHYCTPAGFAILKCNDKKFNGSGPCTNVSTVQCTHGIRPVVSTQLLLNGSRAEEEVIIRSENFTNNAKTIIVQLNKTVEINCTRPNNNTRKSISIGPGRAFYATGDIIGDIRQAHCNLSRAEWNKTLKYISTKLREQFGNKTIIFNGSSGGDPEIVTHSFNCGGEFFYCNTTKLFNSTWDANGNCTGCDESDGNNTITLPCRIKQIVNMWQEVGKCMYAPPIKGLIKCTSNITGLLLTRDGGANNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1046 - protein, 621 aa, Artificial Sequence; identical to SEQ ID NO: 981
  Recombinant HIV protein

SEQ ID NO: 1047 - protein, 627 aa, Artificial Sequence
  Recombinant HIV protein
AENLWVTVYYGVPVWKDAETTLFCASDAKAYETEKHNVWATHACVPTDPNPQEIHLENVTEKFNMWKNNMVEQMHTDIISLWDQSLKPCVKLTPLCVTLHCTNVTSVNTTGDREGLKNCSFNMTTELRDKRQKVYSLFYRLDIVPINENQGSEYRLINCNTSACTQACPKVSFEPIPIHYCTPAGFAILKCKDEGFNGTGLCKNVSTVQCTHGIKPVVSTQLLLNGSLAEKNITIRSENITNNAKIIIVQLVQPVTIKCIRPNNNTRKSIRIGPGQAFYATGDIIGDIRQAHCNVTRSRWNKTLQEVAEKLRTYFGNKTIIFANSSGGDLEITTHSFNCGGEFFYCNTSGLFNSTWYVNSTWNDTDSTQESNDTITLPCRIKQIINMWQRAGQCMYAPPIPGVIKCESNITGLLLTRDGGKDNNVNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1048 - protein, 639 aa, Artificial Sequence
  Recombinant HIV protein
AENLWVTVYYGVPVWKDAETTLFCASDAKAYDREAHNVWATHACVPTDPSPQEIHLENVTEEFNMWKNNMVEQMHTDIISLWDQSLQPCVKLTPLCVTLNCSNINNIPNVNASSIPKDVKEEIKNCSFNMTTELKDKKQNVYSLFYRLDVVPLETNLKQNSSHSRYRLINCNTSACTQACPKVSFEPIPIHYCAPAGFAILKCNDKEFNGTGLCKNVSTVQCTHGIKPVVSTQLLLNGSLAEGKVMVRSENITNNAKNIIVQFNNSVQINCIRPGNNTRKSIHLGPGKVFYATNIIGDIRKAHCNVNRQQWNKALQDVATQLRTHFRNRTIIFNNSLGGDLEITTHSFNCRGEFFYCNTSGLFNSTWMLNSTLNNTWQELNSTNITLQCRIKQIINMWQRVGQCIYAPPIQGEISCESNITGLILTRDGGIINSTDTDEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1049 - protein, 620 aa, Artificial Sequence; identical to SEQ ID NO: 996
  Recombinant HIV protein

SEQ ID NO: 1050 - protein, 654 aa, Artificial Sequence
  Recombinant HIV protein
AENLWVTVYYGVPVWKDAETTLFCASDAKAYDTEVHNVWATHACVPTDPDPQEIHLENVTENFNMWKNNMVEQMHTDIISLWDQSLKPCVKLTPLCVTLNCTDYNNTATNTTSSATTTASSANKTAKEEAVMKNCSFNITTNVRDKVKREYALFYNLDVVKLEEGETSYRLVSCNTSVCTQACPKITFEPIPIHYCAPAGFAILKCNNKTFNGTGPCTNVSTVQCTHGIKPVVSTQLLLNGSLAEGGEVMIRSANFTNNAKTIIVQLSKSVAINCTRPNNNTSKSIHMGPGGAFFATGRIIGDIRKAYCTVNGTEWNTTLRQIVEKFKKQFGENKTIVFKPSAGGDPEIVTHSFNCGGEFFYCNTTNLFNSSSTELNSTWSGNSNDTGKNDTITLPCRIKQIINMWQQVGKCMYAPPISGKINCLSNITGLLLTRDGGSDGGSKNSSKNETGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1051 - protein, 635 aa, Artificial Sequence
  Recombinant HIV protein
AENLWVTVYYGVPVWKDAETTLFCASDAKAYETEVHNVWATHACVPTDPNPQEIHLENVTEYFDMWKNNMVEQMHTDIISLWDQSLKPCVKLTPLCVTLNCTDWTNGTDWNTTNSNNTTISKEETIEGGEMKNCSFNITTATGDKKKERAFFYKLDVAPIDNSNTSYRLISCNTSVCTQACPKISFEPIPIHYCAPAGFAILKCNDKKFNGTGSCTNVSTVQCTHGIRPVVSTQLLLNGSLAEEEVVIRSKNFSDNAKIIIVQLNESVPINCTRPHNNTRKSIHIGPGRAWYATGDIIGDIRKAYCNISEAKWNNTLKQITEKLKEQFNKTIIVFNQPSGGDPEVTMHSFNCGGEFFYCNTSKLFNGTWNSTKRANNTEGIIILQCRIKQIINRWQEVGKCMYAPPIEGQIKCSSNITGLLLTRDGGKTANNTTEFFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1052 - protein, 642 aa, Artificial Sequence
  Recombinant HIV protein
AENLWVTVYYGVPVWKDAETTLFCASDAKAYDTEVHNVWATHACVPTDPNPQEIHLENVTENFNMWKNNMVEQMHTDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1053 - protein, 624 aa, Artificial Sequence
  Recombinant HIV protein
AENLWVTVYYGVPVWKDAETTLFCASDAKAYDTEVHNVWATHACVPTDPNPQEIHLENVTENFNMWKNNMVEQMHTDIISLWDQSLKPCVKLTPLCVTLNCTDLRNATNTTSSSWETMEKGEIKNCSFNITTSIRDKVQKEYALFYNLDVVPIDNASYRLISCNTSVCTQACPKVSFEPIPIHYCAPAGFAILKCNDKKFNGTGPCTNVSTVQCTHGIRPVVSTQLLLNGSLAEEEIVIRSENFTNNAKTIIVQLNESVVINCTRPNNNTRKSINIGPGRALYTTGEIIGDIRQAHCNLSKTQWENTLEQIAIKLKEQFGNNKTIIFNPSSGGDPEIVTHSFNCGGEFFYCNSTQLFTWNDTRKLNNTGRNITLPCRIKQIINMWQEVGKCMYAPPIRGQIRCSSNITGLLLTRDGGKDTNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1054 - protein, 621 aa, Artificial Sequence
  Recombinant HIV protein
AENLWVTVYYGVPVWKDAETTLFCASDAKAYDREVHNVWATHACVPTDPNPQEIHLENVTENFNMWKNNMVEQMHTDIISLWDQSLKPCVKLTPLCVTLHCTNATFKNNVTNDMNKEIRNCSFNTTTEIRDKKQQGYALFYRPDIVLLKENRNNSNNSEYILINCNASTCTQACPKVNFDPIPIHYCAPAGFAILKCNNETFSGKGPCNNVSTVQCTHGIKPVVSTQLLLNGSLAEKEIIIRSENLTDNVKTIIVHLNKSVEIVCTRPNNNTRKSMRIGPGQTFYATGDIIGDIRQAYCNISESMWKETLERVKEKLKENYNNNKTIKFAPSSGGDLEITTHSFNCRGEFFYCNTSKLFSYNGTGNETIILPCRIKQIINMWQGVGRCMYAPPIAGNITCKSNITGLLLVRDGGEDNKTEETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1055 - protein, 630 aa, Artificial Sequence
  Recombinant HIV protein
AENLWVTVYYGVPVWKDAETTLFCASDAKAYEREVHNVWATHACVPTDPSPQEIHLENVTENFNMWKNNMVEQMHTDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGFAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1056 - protein, 621 aa, Artificial Sequence
  Recombinant HIV protein
AENLWVTVYYGVPVWKDAETTLFCASDAKAYEREVHNVWATHACVPTDPNPQEIHLENVTENFNMWKNNMVEQMHTDIISLWDQSLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGFAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1057 - protein, 635 aa, Artificial Sequence
  Recombinant HIV protein
AENLWVTVYYGVPVWKEATTTLFCASDAKAHHAEAHNVWATHACVPTDPNPQEVILENVTEKFNMWKNNMVDQMHEDIISLWDQSLKPCVKLTPLCVTLNCTNATYTNSDSKNSTSNSSLEDSGKGDMNCSFDVTTSIDKKKKTEYAIFDKLDVMNIGNGRYTLLNCNTSVCTQACPKMSFEPIPIHYCTPAGYAILKCNDNKFNGTGPCTNVSTIQCTHGIKPVVSTQLLLNGSLAEGGEVIIRSENLTDNAKTIIVQLKEPVEINCTRPNNNTRKSIHMGPGAAFYARGEVIGDIRQAHCNISRGRWNDTLKQIAKKLREQFNKTISFNQSSGGDLEIVMHTFNCGGEFFYCNTTQLFNSTWNENDTTWNNTAGSNNNETITLPCRIKQIINRWQEVGKCMYAPPISGPINCLSNITGLLLTRDGGDNNNTIETFRPGGGDMRDNWRSELYKYKVVRIEPLGIAPTKCKRRVVGRRRRRRAVGIGAMFLGFLGAAGSTMGAASVTLTVQARLLLSGIVQQQNNLLRAPEAQQHLLQLTVWGIKQLQARVLAMERYLKDQQLLGIWGCSGKLICCTNVPWNASWSNKSLDKIWHNMTWMEWDREIDNYTKLIYTLIEASQIQQEKNEQELFELD

SEQ ID NO: 1058 - protein, 634 aa, Artificial Sequence
  Recombinant HIV protein
AENLWVTVYYGVPVWKEATTTLFCASDAKAYDTEVHNVWATHACVPTDPNPQEVALENVTENFNMWKNNMVEQMHEDIISLWDQSLKPCVKLTPLCVTLNCTDLRNATSRNVTNTTSSSRGMVGGGEMKNCSFNITTGIRGKVQKEYALFYELDIVPIDNKIDRYRLISCNTSVCTQACPKVSFEPIPIHYCAPAGFAILKCKDKKFNGKGPCSNVSTVQCTHGIRPVVSTQLLLNGSLAEEEVVIRSENFTNNAKTIIVQLNESVEINCTRPNNNTRKSINIGPGRAFYTTGEIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQEVGRCMYAPPIRGQIRCSSNITGLLLTRDGGPEDNKTEVFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQHLLQLTVWGIKQLQARVLAVERYLRDQQLLGIWGCSGKLICCTAVPWNASWSNKSLNKIWDNMTWMEWDREINNYTSIIYSLIEESQNQQEKNEQELLELD

SEQ ID NO: 1059 - protein, 650 aa, Artificial Sequence
  Recombinant HIV protein
AENLWVTVYYGVPVWKEATTTLFCASDAKAYETEVHNVWATHACVPTDPNPQEVKLENVTEDFNVWKNDMVTQMHEDIISLWDQSLKPCVKLTPLCVTLHCTDVNTTCITTNNSTMTNSSNSSTEGNCSSYNYNGREELRNCSFNITTSIQDKVQDYAIFYKLDIVPIKSDNSDNTSYRLINCNTSVCTQACPKISFEPIPIHYCAPAGFAILKCNDKKFSGKGTCNNVSTVQCTHGIRPVVSTQLLLNGSLAEEGVVLRSENFTNNAKTIIVQLKDPVKIECERPNNNTIKSIHLGPGRAWHATGQIIGDIRKAFCTLNSTNWTNTLKQMVEKLREQFENKTIAFNQSTGGDPEIVMHTFNCGGEFFYCNTTQLFNSIWYNTTNSSWNNKTWSNNTITLPCRIKQIINMWQQVGKCIYAPPIKGKIKCISNITGLLLTRDGGDTNNGTEIFRPGGGDMRDNWRSELYKYKVVQIEPLGVAPTKCKRRVVGRRRRRRAVGLGAMFLGFLGAAGSTMGAASITLTVQARQLLSGIVQQQNNLLRAPEAQQHLLQLTVWGIKQLQARVLAVERYLKDQQLLGIWGCSGKLICCTAVPWNASWSNKSQEEIWDNLTWMQWEKEINNYTSVIYTLLEQSQNQQEKNEQELLELD

SEQ ID NO: 1060 - protein, 633 aa, Artificial Sequence
  Recombinant HIV protein
AENLWVTVYYGVPVWKEATTTLFCASDAKGYEKEVHNVWATHACVPTDPNPQEVVLENVTENFNMWKNNMVEQMHEDIISLWDQSLKPCVKLTPLCVTLNCSDVNTTSVNTTASSMEGGEIKNCSFNTTTSMSDKMQKEYALFYTLDVVPIVKENNTYRLISCNTSVCTQACPKVSFEPIPIHYCAPAGFAILMCNNKTFDGKGPCNNVSTVQCTHGIKPVVSTQLLLNGSLAEEEVVIRSDNFTDNAKTIIVHLNESIEITCTRPNNNTSKSITIGPGRAFYATGRIIGDIRKAHCNISGEKWHNALEQIVKKLGEKFENATTIRFNQSSGGDQEIVMHTFNCGGEFFYCNSTQLFNSTWWPNGTTTEWSNETSNGTITLPCRIKQIINMWQEVGKCMYAPPISGPISCSSNITGLLLVRDGGNDNETNGTETFRPGGGDMRDNWRSELYKYKVVKIEPLGVAPTKCKRRVVGRRRRRRAVGLGAMFLGFLGAAGSTMGAASITLTVQARLLLSGIVQQQNNLLRAPEAQQHLLQLTVWGIKQLQARVLAIERYLKDQQLLGIWGCSGKLICCTAVPWNSSWSNKSLKWIWDNMTWMEWEKEIDNYTGIIYNLLEESQNQQDKNEKELLELD

SEQ ID NO: 1061 - protein, 631 aa, Artificial Sequence
  Recombinant HIV protein
AENLWVTVYYGVPVWTEAKTTLFCASDAKAYEKEVHNVWATHACVPTDPNPQEIFLKNVTENFNMWKNDMVDQMHEDIISLWDQSLKPCVKLTPLCVTLNCVTYNNSMNSSATYNNSMNGEIKNCSFNTTTELRDKKQKVYALFYRTDVVPLNNNNNNSEYILINCNTSTCTQACPKVSFDPIPIHYCAPAGYAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRCMYAPPIEGNITCNSNITGLLLTRDGGGNVTEINRTEIFRPGGGNMKDNWRNELYKYKVVEIKPLGVAPTGCKRKVVGRRRRRRAVGLGAVLFGFLGAAGSTMGAASITLTAQARQLLSGIVQQQSNLLRAPEAQQHMLQLTVWGIKQLQARVLAIERYLKDQQLLGLWGCSGKLICCTNVPWNSSWSNKSQTDIWNNTTWMQWEREISNYTDTIYRLLEDSQNQQEENEKDLLALD

SEQ ID NO: 1062 - protein, 630 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVEIKPLGVAPTKCKRKVVGRRRRRRAVGLGAVLLGFLGAAGSTMGAASITLTVQARQLLSGIVQQQSNLLRAPEAQQHLLQLTVWGIKQLQTRVLAIERYLKDQQLLGLWGCSGKLICCTAVPWNSSWSNKSLGDIWDNMTWMQWDREISNYTNTIFRLLEDSQNQQEKNEKDLLALD

SEQ ID NO: 1063 - protein, 629 aa, Artificial Sequence
  Recombinant HIV protein
AENLWVTVYYGVPVWKETTTTLFCASDAKAYDTEVHNVWATHACVPTDPNPQEVVLENVTEDFNMWKNNMVEQMQEDVINLWDQSLKPCVKLTPLCVTLNCKDVNATNTTSSSEGMMERGEIKNCSFNITKSIRNKVQKEYALFYKLDVVPIDNKNNTKYRLISCNTSVCTQACPKVSFEPIPIHYCAPAGFAILKCNNKTFNGKGQCKNVSTVQCTHGIRPVVSTQLLLNGSLAEEKVVIRSDNFTDNAKTIIVQLNESVKINCTRPSNNTRKSIHIGPGRAFYTTGEIIGDIRQAHCNISRAQWNNTLKQIVEKLREQFNNKTIVFTHSSGGDPEIVMHSFNCGGEFFYCNSTQLFNSTWNDTEKSSGTEGNDTIILPCRIKQIINMWQEVGKCMYAPPIKGQIRCSSNITGLLLTRDGGKNESEIEIFRPGGGDMRDNWRSELYKYKVVKIEPLGVAPTKCKRRVVGRRRRRRAVGIGALFLGFLGAAGSTMGAASMTLTVQARQLLSGIVQQQNNLLRAPEAQQHMLQLTVWGIKQLQARVLAVERYLKDQQLMGIWGCSGKLICCTAVPWNTSWSNKSLDSIWNNMTWMEWEKEIENYTNTIYTLIEESQIQQEKNEQELLELD

SEQ ID NO: 1064 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDEVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1065 - protein, 631 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTKCKRRVVGRRRRRRAVGLGAVFIGFLGAAGSTMGAASITLTVQARQLLSGIVQQQSNLLRAPEAQQHLLKLTVWGIKQLQARVLAVERYLKDQQLLGIWGCSGKLICCTNVPWNSSWSNKSYNEIWENMTWLQWDKEINNYTELIYSLIEESQNQQEKNEQDLLALD

SEQ ID NO: 1066 - protein, 647 aa, Artificial Sequence
  Recombinant HIV protein
AENLWVTVYYGVPVWKEATTTLFCASDAKAYNTEVHNVWATHACVPTDPNPQEVGLENVTENFNMWKNNMVEQMHEDIISLWDQSLKPCVKLTPLCVTLNCSDLRNATNTTNPTVSSRVIKKEMMGEVKNCSFNVTTDIRDRMQKVYALFYRPDVVPIQDHTIENNNTIENNTTYRLISCNTSVCTQACPKISFEPIPIHYCTPAGFAILKCNDKKFNGSGPCTNVSTVQCTHGIRPVVSTQLLLNGSRAEEEVIIRSENFTNNAKTIIVQLNKTVEINCTRPNNNTRKSISIGPGRAFYATGDIIGDIRQAHCNLSRAEWNKTLKYISTKLREQFGNKTIIFNGSSGGDPEIVTHSFNCGGEFFYCNTTKLFNSTWDANGNCTGCDESDGNNTITLPCRIKQIVNMWQEVGKCMYAPPIKGLIKCTSNITGLLLTRDGGANNTNETFRPGGGDMRDNWRSELYKYKVVQIEPLGIAPTRCRRRVVGRRRRRRAVGTLGAMFLGFLGAAGSTMGAASVTLTVQARQLLSGIVQQQNNLLKAPEAQQHMLQLTVWGIKQLQARVLAIERYLKDQQLLGIWGCSGKLICCTAVPWNTSWSNKSFNKIWDNMTWMEWEREIDNYTGLIYNLLEESQNQQEKNEQDLLALD

SEQ ID NO: 1067 - protein, 621 aa, Artificial Sequence
  Recombinant HIV protein
AENLWVTVYYGVPVWKDAETTLFCASDAKAYSTEKHNIWATHACVPTDPNPQEIHLENVTEEFNMWKNNMVEQMHTDIISLWDQSLRPCVKLTPLCVTLNCTNVNNNTTNVNNNTGWDEERKNCSFNITTELRDKRQKVYSLFYKLDVVQIDNSSYRLINCNTSACTQACPKVTFEPIPIHYCAPAGFAILKCKDEKFNGTGPCKNVSTVQCTHGIKPVVSTQLLLNGSLAEKEVMIRSENFTNNAKNILVQFKEPVKINCTRPDNNTRTSIRIGPGQAFYATGIIGDIRQAYCTVNGSEWNKALQKVVEQLRSSFENKTIIFANSSGGDLEITTHSFNCGGEFFYCNTSGLFDSTWNDTDSRQENGTITLPCRIKQIINMWQRTGQCIYAPPIQGAIRCVSNITGLILTRDGGNNNSTNETFRPGGGDMRDNWRSELYKYKVVKIEPLGVAPTKCRRRVVGRRRRRRAVGIGAVFLGFLGAAGSTMGAASITLTVQARQLLSGIVQQQSNLLKAPEAQQHLLRLTVWGIKQLQARVLAVERYLKDQQLLGIWGCSGKLICCTNVPWNSSWSNKSQSEIWENMTWLQWEKEISNYTQIIYTLIEESQNQQEKNEQDLLALD

SEQ ID NO: 1068 - protein, 627 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNVTSVNTTGDREGLKNCSFNMTTELRDKRQKVYSLFYRLDIVPINENQGSEYRLINCNTSACTQACPKVSFEPIPIHYCTPAGFAILKCKDEGFNGTGLCKNVSTVQCTHGIKPVVSTQLLLNGSLAEKNITIRSENITNNAKIIIVQLVQPVTIKCIRPNNNTRKSIRIGPGQAFYATGDIIGDIRQAHCNVTRSRWNKTLQEVAEKLRTYFGNKTIIFANSSGGDLEITTHSFNCGGEFFYCNTSGLFNSTWYVNSTWNDTDSTQESNDTITLPCRIKQIINMWQRAGQCMYAPPIPGVIKCESNITGLLLTRDGGKDNNVNETFRPGGGDMRDNWRSELYKYKVVEIEPLGVAPTRCKRRVVGRRRRRRAVGIGAVFLGFLGAAGSTMGATSITLTVQARQLLSGIVQQQNNLLRAPEAQQHLLKLTVWGIKQLQARVLAVERYLRDQQLLGIWGCSGKLICCTNVPWNSSWSNKSLDEIWNNMTWLQWDKEINNYTQLIYRLIEESQNQQEKNEKELLELD

SEQ ID NO: 1069 - protein, 639 aa, Artificial Sequence
  Recombinant HIV protein
AENLWVTVYYGVPVWRDAETTLFCASDAKAYDREAHNVWATHACVPTDPSPQEVPLGNVTEEFNMWKNNMVEQMHTDIISLWDQSLQPCVKLTPLCVTLNCSNINNIPNVNASSIPKDVKEEIKNCSFNMTTELKDKKQNVYSLFYRLDVVPLETNLKQNSSHSRYRLINCNTSACTQACPKVSFEPIPIHYCAPAGFAILKCNDKEFNGTGLCKNVSTVQCTHGIKPVVSTQLLLNGSLAEGKVMVRSENITNNAKNIIVQFNNSVQINCIRPGNNTRKSIHLGPGKVFYATNIIGDIRKAHCNVNRQQWNKALQDVATQLRTHFRNRTIIFNNSLGGDLEITTHSFNCRGEFFYCNTSGLFNSTWMLNSTLNNTWQELNSTNITLQCRIKQIINMWQRVGQCIYAPPIQGEISCESNITGLILTRDGGIINSTDTDEIFRPGGGDMRDNWRSELYKYKVVKIEPLGVAPTKCKRRVVGRRRRRRAVGFGAFFLGFLGAAGSTMGAASITLTVQARQLLSGIVQQQNNLLRAPEAQQHLLKLTVWGIKQLQARVLAVERYLKDQQLLGIWGCSGKLICCTTVPWNSSWSNKSQSEIWDNMTWMQWDKEINNYTQIIYDLIEESQRQQEKNEQDLLALD

SEQ ID NO: 1070 - protein, 620 aa, Artificial Sequence
  Recombinant HIV protein
AENLWVTVYYGVPVWKDAETTLFCASDAKAYDTEVHNVWATHACVPTDPNPQEIHLENVTEDFNMWKNNMVEQMHTDIISLWDQSLKPCVKLTPLCVTLDCNATASNVTNEMRNCSFNITTELKDKKQQVYSLFYKLDVVQINEKNETDKYRLINCNTSACTQACPKVSFEPIPIHYCAPAGFAVLKCKDTEFNGTGPCKNVSTVQCTHGIRPVISTQLLLNGSLAEEGIQIRSENITNNAKTIIVQLDKAVKINCTRPNNNTRKGVRIGPGQAFYATGGIIGDIRQAHCNVSRAKWNDTLRGVAKKLREHFKNKTIIFEKSSGGDIEITTHSFNCGGEFFYCSTSGLFNSTWESNSTESNNTTSNDTITLTCRIKQIINMWQKVGQCMYAPPIQGVIRCESNITGLLLTRDGGNNSTNEIFRPGGGNMRDNWRSELYKYKVVKIEPLGVAPSRCKRRVVGRRRRRRAVGIGAVFLGFLGAAGSTMGAASITLTAQARQLLSGIVQQQSNLLRAPEAQQHMLKLTVWGIKQLQARVLAVERYLKDQQLLGIWGCSGKLICCTNVPWNSSWSNKSMNEIWDNMTWLQWDKEISNYTQIIYNLIEESQNQQEKNEQDLLALD

SEQ ID NO: 1071 - protein, 655 aa, Artificial Sequence
  Recombinant HIV protein
AENLWVTVYYGVPVWKEAVTTLFCASDAKAYDTEVHNVWATHACVPTDPDPQEVVLENVTENFNMWKNNMVEQMHEDIISLWDQSLKPCVKLTPLCVTLNCTDYNNTATNTTSSATTTASSANKTAKEEAVMKNCSFNITTNVRDKVKREYALFYNLDVVKLEEGETSYRLVSCNTSVCTQACPKITFEPIPIHYCAPAGFAILKCNNKTFNGTGPCTNVSTVQCTHGIKPVVSTQLLLNGSLAEGGEVMIRSANFTNNAKTIIVQLSKSVAINCTRPNNNTSKSIHMGPGGAFFATGRIIGDIRKAYCTVNGTEWNTTLRQIVEKFKKQFGENKTIVFKPSAGGDPEIVTHSFNCGGEFFYCNTTNLFNSSSTELNSTWSGNSNDTGKNDTITLPCRIKQIINMWQQVGKCMYAPPISGKINCLSNITGLLLTRDGGSDGGSKNSSKNETGTEIFRPGGGDMRDNWRSELYKYKVVRIEPLGVAPTKCKRRAVGRRRRRRALGLGALFLGFLGAAGSTMGAASVTLTVQARQLLSGIVQQQNNLLRAPEAQQHLLQLTVWGIKQLQARLLAVERYLKDQQLLGIWGCSGKLICCTTVPWNNSWSKNKTYEYIWNNMTWIEWEREIDNYTGLIYNLIEKSQNQQEKNEKELLELD

SEQ ID NO: 1072 - protein, 635 aa, Artificial Sequence
  Recombinant HIV protein
AENLWVTVYYGVPVWKEATTTLFCASDAKAYETEVHNVWATHACVPTDPNPQELVLENVTEYFDMWKNNMVEQMHEDIISLWDQSLKPCVKLTPLCVTLNCTDWTNGTDWNTTNSNNTTISKEETIEGGEMKNCSFNITTATGDKKKERAFFYKLDVAPIDNSNTSYRLISCNTSVCTQACPKISFEPIPIHYCAPAGFAILKCNDKKFNGTGSCTNVSTVQCTHGIRPVVSTQLLLNGSLAEEEVVIRSKNFSDNAKIIIVQLNESVPINCTRPHNNTRKSIHIGPGRAWYATGDIIGDIRKAYCNISEAKWNNTLKQITEKLKEQFNKTIIVFNQPSGGDPEVTMHSFNCGGEFFYCNTSKLFNGTWNSTKRANNTEGIIILQCRIKQIINRWQEVGKCMYAPPIEGQIKCSSNITGLLLTRDGGKTANNTTEFFRPGGGNMKDNWRSELYKYKVVRIEPLGVAPTKCKRRVVGRRRRRRAIGIGAVFLGFLGAAGSTMGAASITLTVQARKLLSGIVQQQNNLLRAPEAQQHLLQLTVWGIKQLQARVLAVERYLRDQQLLGIWGCSGKLICCTAVPWNSSWSNKSLDTIWNNMTWMQWEKEIDNYTGLIYTLIEESQIQQEKNELDLLKLD

SEQ ID NO: 1073 - protein, 643 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVIKIEPLGVAPTRCKRRVVGRRRRRRAVGTLGAMFLGFLGAAGSTMGAASVTLTVQARLLLSGIVQQQNNLLRAPEAQQHMLQLTVWGIKQLQARVLAVERYLRDQQLLGIWGCSGKLICCTNVPWNASWSNKSLNNIWENMTWMEWEREIDNYTDLIYILLEKSQIQQEKNEQELLELD

SEQ ID NO: 1074 - protein, 624 aa, Artificial Sequence
  Recombinant HIV protein
AENLWVTVYYGVPVWKEATTTLFCASDAKAYDTEVHNVWATHACVPTDPNPQEVKLENVTENFNMWKNNMVEQMHEDIISLWDQSLKPCVKLTPLCVTLNCTDLRNATNTTSSSWETMEKGEIKNCSFNITTSIRDKVQKEYALFYNLDVVPIDNASYRLISCNTSVCTQACPKVSFEPIPIHYCAPAGFAILKCNDKKFNGTGPCTNVSTVQCTHGIRPVVSTQLLLNGSLAEEEIVIRSENFTNNAKTIIVQLNESVVINCTRPNNNTRKSINIGPGRALYTTGEIIGDIRQAHCNLSKTQWENTLEQIAIKLKEQFGNNKTIIFNPSSGGDPEIVTHSFNCGGEFFYCNSTQLFTWNDTRKLNNTGRNITLPCRIKQIINMWQEVGKCMYAPPIRGQIRCSSNITGLLLTRDGGKDTNGTEIFRPGGGDMRDNWRSELYKYKVVKIEPLGVAPTKCKRRVVGRRRRRRAVGLGALFLGFLGAAGSTMGAASITLTVQARQLLSGIVQQQNNLLRAPEAQQHLLQLTVWGIKQLQARVLAVERYLRDQQLLGIWGCSGKLICCTTVPWNTSWSNKSLNEIWDNMTWMKWEREIDNYTHIIYSLIEQSQNQQEKNEQELLALD

SEQ ID NO: 1075 - protein, 621 aa, Artificial Sequence
  Recombinant HIV protein
AENLWVTVYYGVPVWTDAKTTLFCASDAKAYDREVHNVWATHACVPTDPNPQEIVLENVTENFNMWKNDMVDQMHEDIISLWDQSLKPCVKLTPLCVTLHCTNATFKNNVTNDMNKEIRNCSFNTTTEIRDKKQQGYALFYRPDIVLLKENRNNSNNSEYILINCNASTCTQACPKVNFDPIPIHYCAPAGYAILKCNNETFSGKGPCNNVSTVQCTHGIKPVVSTQLLLNGSLAEKEIIIRSENLTDNVKTIIVHLNKSVEIVCTRPNNNTRKSMRIGPGQTFYATGDIIGDIRQAYCNISESMWKETLERVKEKLKENYNNNKTIKFAPSSGGDLEITTHSFNCRGEFFYCNTSKLFSYNGTGNETIILPCRIKQIINMWQGVGRCMYAPPIAGNITCKSNITGLLLVRDGGEDNKTEETFRPGGGNMKDNWRSELYKYKVIELKPLGIAPTGCKRRVVGRRRRRRAVGIGAVFLGFLGAARSTMGAASLALTVQARQLLSGIVQQQSNLLRAPEAQQHMLQLTVWGIKQLQTRVLAIERYLKDQQLLGIWGCSGKLICCTNVPWNSSWSNKSQTDIWNNMTWMEWDREISNYTDTIYRLLEDSQTQQEKNEKDLLALD

SEQ ID NO: 1076 - protein, 630 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVEIKPLGVAPTECKRRVVGRRRRRRAVGIGAVLLGFLGAAGSTMGAASITLTAQARQVLSGIVQQQSNLLRAPEAQQHLLQLTVWGIKQLQTRVLALERYLKDQQLLGLWGCSGRLICCTAVPWNSSWSNKSLTDIWDNMTWMQWDKEVSNYTNTIYRLLEDSQSQQEKNEKDLLALD

SEQ ID NO: 1077 - protein, 621 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVEIKPLGIAPTECKRRVVGRRRRRRAVGIGAVFLGFLGAAGSTMGAASITLTVQARQLLSGIVQQQSNLLRAPEAQQHMLQLTVWGIKQLQARVLAIERYLKDQQLLGIWGCSGKLICCTNVPWNSSWSNKSLGDIWDNMTWMEWDREISNYTNIIFGLLEDSQNQQERNEKDLLALD

SEQ ID NO: 1078 - protein, 644 aa, Artificial Sequence
  Recombinant HIV protein
AENLWVTVYYGVPVWKEATTTLFCASDAKAHHAEAHNVWATHACVPTDPNPQEVILENVTEKFNMWKNNMVDQMHEDIISLWDQSLKPCVKLTPLCVTLNCTNATYTNSDSKNSTSNSSLEDSGKGDMNCSFDVTTSIDKKKKTEYAIFDKLDVMNIGNGRYTLLNCNTSVCTQACPKMSFEPIPIHYCTPAGYAILKCNDNKFNGTGPCTNVSTIQCTHGIKPVVSTQLLLNGSLAEGGEVIIRSENLTDNAKTIIVQLKEPVEINCTRPNNNTRKSIHMGPGAAFYARGEVIGDIRQAHCNISRGRWNDTLKQIAKKLREQFNKTISFNQSSGGDLEIVMHTFNCGGEFFYCNTTQLFNSTWNENDTTWNNTAGSNNNETITLPCRIKQIINRWQEVGKCMYAPPISGPINCLSNITGLLLTRDGGDNNNTIETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1079 - protein, 643 aa, Artificial Sequence
  Recombinant HIV protein
AENLWVTVYYGVPVWKEATTTLFCASDAKAYDTEVHNVWATHACVPTDPNPQEVALENVTENFNMWKNNMVEQMHEDIISLWDQSLKPCVKLTPLCVTLNCTDLRNATSRNVTNTTSSSRGMVGGGEMKNCSFNITTGIRGKVQKEYALFYELDIVPIDNKIDRYRLISCNTSVCTQACPKVSFEPIPIHYCAPAGFAILKCKDKKFNGKGPCSNVSTVQCTHGIRPVVSTQLLLNGSLAEEEVVIRSENFTNNAKTIIVQLNESVEINCTRPNNNTRKSINIGPGRAFYTTGEIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQEVGRCMYAPPIRGQIRCSSNITGLLLTRDGGPEDNKTEVFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1080 - protein, 659 aa, Artificial Sequence
  Recombinant HIV protein
AENLWVTVYYGVPVWKEATTTLFCASDAKAYETEVHNVWATHACVPTDPNPQEVKLENVTEDFNVWKNDMVTQMHEDIISLWDQSLKPCVKLTPLCVTLHCTDVNTTCITTNNSTMTNSSNSSTEGNCSSYNYNGREELRNCSFNITTSIQDKVQDYAIFYKLDIVPIKSDNSDNTSYRLINCNTSVCTQACPKISFEPIPIHYCAPAGFAILKCNDKKFSGKGTCNNVSTVQCTHGIRPVVSTQLLLNGSLAEEGVVLRSENFTNNAKTIIVQLKDPVKIECERPNNNTIKSIHLGPGRAWHATGQIIGDIRKAFCTLNSTNWTNTLKQMVEKLREQFENKTIAFNQSTGGDPEIVMHTFNCGGEFFYCNTTQLFNSIWYNTTNSSWNNKTWSNNTITLPCRIKQIINMWQQVGKCIYAPPIKGKIKCISNITGLLLTRDGGDTNNGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1081 - protein, 642 aa, Artificial Sequence
  Recombinant HIV protein
AENLWVTVYYGVPVWKEATTTLFCASDAKGYEKEVHNVWATHACVPTDPNPQEVVLENVTENFNMWKNNMVEQMHEDIISLWDQSLKPCVKLTPLCVTLNCSDVNTTSVNTTASSMEGGEIKNCSFNTTTSMSDKMQKEYALFYTLDVVPIVKENNTYRLISCNTSVCTQACPKVSFEPIPIHYCAPAGFAILMCNNKTFDGKGPCNNVSTVQCTHGIKPVVSTQLLLNGSLAEEEVVIRSDNFTDNAKTIIVHLNESIEITCTRPNNNTSKSITIGPGRAFYATGRIIGDIRKAHCNISGEKWHNALEQIVKKLGEKFENATTIRFNQSSGGDQEIVMHTFNCGGEFFYCNSTQLFNSTWWPNGTTTEWSNETSNGTITLPCRIKQIINMWQEVGKCMYAPPISGPISCSSNITGLLLVRDGGNDNETNGTETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1082 - protein, 640 aa, Artificial Sequence
  Recombinant HIV protein
AENLWVTVYYGVPVWTEAKTTLFCASDAKAYEKEVHNVWATHACVPTDPNPQEIFLKNVTENFNMWKNDMVDQMHEDIISLWDQSLKPCVKLTPLCVTLNCVTYNNSMNSSATYNNSMNGEIKNCSFNTTTELRDKKQKVYALFYRTDVVPLNNNNNNSEYILINCNTSTCTQACPKVSFDPIPIHYCAPAGYAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRCMYAPPIEGNITCNSNITGLLLTRDGGGNVTEINRTEIFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1083 - protein, 639 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1084 - protein, 638 aa, Artificial Sequence
  Recombinant HIV protein
AENLWVTVYYGVPVWKETTTTLFCASDAKAYDTEVHNVWATHACVPTDPNPQEVVLENVTEDFNMWKNNMVEQMQEDVINLWDQSLKPCVKLTPLCVTLNCKDVNATNTTSSSEGMMERGEIKNCSFNITKSIRNKVQKEYALFYKLDVVPIDNKNNTKYRLISCNTSVCTQACPKVSFEPIPIHYCAPAGFAILKCNNKTFNGKGQCKNVSTVQCTHGIRPVVSTQLLLNGSLAEEKVVIRSDNFTDNAKTIIVQLNESVKINCTRPSNNTRKSIHIGPGRAFYTTGEIIGDIRQAHCNISRAQWNNTLKQIVEKLREQFNNKTIVFTHSSGGDPEIVMHSFNCGGEFFYCNSTQLFNSTWNDTEKSSGTEGNDTIILPCRIKQIINMWQEVGKCMYAPPIKGQIRCSSNITGLLLTRDGGKNESEIEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1085 - protein, 637 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDEVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1086 - protein, 640 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1087 - protein, 655 aa, Artificial Sequence
  Recombinant HIV protein
AENLWVTVYYGVPVWKEATTTLFCASDAKAYNTEVHNVWATHACVPTDPNPQEVGLENVTENFNMWKNNMVEQMHEDIISLWDQSLKPCVKLTPLCVTLNCSDLRNATNTTNPTVSSRVIKKEMMGEVKNCSFNVTTDIRDRMQKVYALFYRPDVVPIQDHTIENNNTIENNTTYRLISCNTSVCTQACPKISFEPIPIHYCTPAGFAILKCNDKKFNGSGPCTNVSTVQCTHGIRPVVSTQLLLNGSRAEEEVIIRSENFTNNAKTIIVQLNKTVEINCTRPNNNTRKSISIGPGRAFYATGDIIGDIRQAHCNLSRAEWNKTLKYISTKLREQFGNKTIIFNGSSGGDPEIVTHSFNCGGEFFYCNTTKLFNSTWDANGNCTGCDESDGNNTITLPCRIKQIVNMWQEVGKCMYAPPIKGLIKCTSNITGLLLTRDGGANNTNETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1088 - protein, 630 aa, Artificial Sequence
  Recombinant HIV protein
AENLWVTVYYGVPVWKDAETTLFCASDAKAYSTEKHNIWATHACVPTDPNPQEIHLENVTEEFNMWKNNMVEQMHTDIISLWDQSLRPCVKLTPLCVTLNCTNVNNNTTNVNNNTGWDEERKNCSFNITTELRDKRQKVYSLFYKLDVVQIDNSSYRLINCNTSACTQACPKVTFEPIPIHYCAPAGFAILKCKDEKFNGTGPCKNVSTVQCTHGIKPVVSTQLLLNGSLAEKEVMIRSENFTNNAKNILVQFKEPVKINCTRPDNNTRTSIRIGPGQAFYATGIIGDIRQAYCTVNGSEWNKALQKVVEQLRSSFENKTIIFANSSGGDLEITTHSFNCGGEFFYCNTSGLFDSTWNDTDSRQENGTITLPCRIKQIINMWQRTGQCIYAPPIQGAIRCVSNITGLILTRDGGNNNSTNETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1089 - protein, 636 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNVTSVNTTGDREGLKNCSFNMTTELRDKRQKVYSLFYRLDIVPINENQGSEYRLINCNTSACTQACPKVSFEPIPIHYCTPAGFAILKCKDEGFNGTGLCKNVSTVQCTHGIKPVVSTQLLLNGSLAEKNITIRSENITNNAKIIIVQLVQPVTIKCIRPNNNTRKSIRIGPGQAFYATGDIIGDIRQAHCNVTRSRWNKTLQEVAEKLRTYFGNKTIIFANSSGGDLEITTHSFNCGGEFFYCNTSGLFNSTWYVNSTWNDTDSTQESNDTITLPCRIKQIINMWQRAGQCMYAPPIPGVIKCESNITGLLLTRDGGKDNNVNETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1090 - protein, 648 aa, Artificial Sequence
  Recombinant HIV protein
AENLWVTVYYGVPVWRDAETTLFCASDAKAYDREAHNVWATHACVPTDPSPQEVPLGNVTEEFNMWKNNMVEQMHTDIISLWDQSLQPCVKLTPLCVTLNCSNINNIPNVNASSIPKDVKEEIKNCSFNMTTELKDKKQNVYSLFYRLDVVPLETNLKQNSSHSRYRLINCNTSACTQACPKVSFEPIPIHYCAPAGFAILKCNDKEFNGTGLCKNVSTVQCTHGIKPVVSTQLLLNGSLAEGKVMVRSENITNNAKNIIVQFNNSVQINCIRPGNNTRKSIHLGPGKVFYATNIIGDIRKAHCNVNRQQWNKALQDVATQLRTHFRNRTIIFNNSLGGDLEITTHSFNCRGEFFYCNTSGLFNSTWMLNSTLNNTWQELNSTNITLQCRIKQIINMWQRVGQCIYAPPIQGEISCESNITGLILTRDGGIINSTDTDEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1091 - protein, 629 aa, Artificial Sequence
  Recombinant HIV protein
AENLWVTVYYGVPVWKDAETTLFCASDAKAYDTEVHNVWATHACVPTDPNPQEIHLENVTEDFNMWKNNMVEQMHTDIISLWDQSLKPCVKLTPLCVTLDCNATASNVTNEMRNCSFNITTELKDKKQQVYSLFYKLDVVQINEKNETDKYRLINCNTSACTQACPKVSFEPIPIHYCAPAGFAVLKCKDTEFNGTGPCKNVSTVQCTHGIRPVISTQLLLNGSLAEEGIQIRSENITNNAKTIIVQLDKAVKINCTRPNNNTRKGVRIGPGQAFYATGGIIGDIRQAHCNVSRAKWNDTLRGVAKKLREHFKNKTIIFEKSSGGDIEITTHSFNCGGEFFYCSTSGLFNSTWESNSTESNNTTSNDTITLTCRIKQIINMWQKVGQCMYAPPIQGVIRCESNITGLLLTRDGGNNSTNEIFRPGGGNMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1092 - protein, 663 aa, Artificial Sequence
  Recombinant HIV protein
AENLWVTVYYGVPVWKEAVTTLFCASDAKAYDTEVHNVWATHACVPTDPDPQEVVLENVTENFNMWKNNMVEQMHEDIISLWDQSLKPCVKLTPLCVTLNCTDYNNTATNTTSSATTTASSANKTAKEEAVMKNCSFNITTNVRDKVKREYALFYNLDVVKLEEGETSYRLVSCNTSVCTQACPKITFEPIPIHYCAPAGFAILKCNNKTFNGTGPCTNVSTVQCTHGIKPVVSTQLLLNGSLAEGGEVMIRSANFTNNAKTIIVQLSKSVAINCTRPNNNTSKSIHMGPGGAFFATGRIIGDIRKAYCTVNGTEWNTTLRQIVEKFKKQFGENKTIVFKPSAGGDPEIVTHSFNCGGEFFYCNTTNLFNSSSTELNSTWSGNSNDTGKNDTITLPCRIKQIINMWQQVGKCMYAPPISGKINCLSNITGLLLTRDGGSDGGSKNSSKNETGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1093 - protein, 644 aa, Artificial Sequence
  Recombinant HIV protein
AENLWVTVYYGVPVWKEATTTLFCASDAKAYETEVHNVWATHACVPTDPNPQELVLENVTEYFDMWKNNMVEQMHEDIISLWDQSLKPCVKLTPLCVTLNCTDWTNGTDWNTTNSNNTTISKEETIEGGEMKNCSFNITTATGDKKKERAFFYKLDVAPIDNSNTSYRLISCNTSVCTQACPKISFEPIPIHYCAPAGFAILKCNDKKFNGTGSCTNVSTVQCTHGIRPVVSTQLLLNGSLAEEEVVIRSKNFSDNAKIIIVQLNESVPINCTRPHNNTRKSIHIGPGRAWYATGDIIGDIRKAYCNISEAKWNNTLKQITEKLKEQFNKTIIVFNQPSGGDPEVTMHSFNCGGEFFYCNTSKLFNGTWNSTKRANNTEGIIILQCRIKQIINRWQEVGKCMYAPPIEGQIKCSSNITGLLLTRDGGKTANNTTEFFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1094 - protein, 651 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1095 - protein, 633 aa, Artificial Sequence
  Recombinant HIV protein
AENLWVTVYYGVPVWKEATTTLFCASDAKAYDTEVHNVWATHACVPTDPNPQEVKLENVTENFNMWKNNMVEQMHEDIISLWDQSLKPCVKLTPLCVTLNCTDLRNATNTTSSSWETMEKGEIKNCSFNITTSIRDKVQKEYALFYNLDVVPIDNASYRLISCNTSVCTQACPKVSFEPIPIHYCAPAGFAILKCNDKKFNGTGPCTNVSTVQCTHGIRPVVSTQLLLNGSLAEEEIVIRSENFTNNAKTIIVQLNESVVINCTRPNNNTRKSINIGPGRALYTTGEIIGDIRQAHCNLSKTQWENTLEQIAIKLKEQFGNNKTIIFNPSSGGDPEIVTHSFNCGGEFFYCNSTQLFTWNDTRKLNNTGRNITLPCRIKQIINMWQEVGKCMYAPPIRGQIRCSSNITGLLLTRDGGKDTNGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1096 - protein, 630 aa, Artificial Sequence
  Recombinant HIV protein
AENLWVTVYYGVPVWTDAKTTLFCASDAKAYDREVHNVWATHACVPTDPNPQEIVLENVTENFNMWKNDMVDQMHEDIISLWDQSLKPCVKLTPLCVTLHCTNATFKNNVTNDMNKEIRNCSFNTTTEIRDKKQQGYALFYRPDIVLLKENRNNSNNSEYILINCNASTCTQACPKVNFDPIPIHYCAPAGYAILKCNNETFSGKGPCNNVSTVQCTHGIKPVVSTQLLLNGSLAEKEIIIRSENLTDNVKTIIVHLNKSVEIVCTRPNNNTRKSMRIGPGQTFYATGDIIGDIRQAYCNISESMWKETLERVKEKLKENYNNNKTIKFAPSSGGDLEITTHSFNCRGEFFYCNTSKLFSYNGTGNETIILPCRIKQIINMWQGVGRCMYAPPIAGNITCKSNITGLLLVRDGGEDNKTEETFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1097 - protein, 639 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1098 - protein, 630 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1099 - protein, 784 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1100 - protein, 787 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCNISGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1101 - protein, 799 aa, Artificial Sequence
  Recombinant HIV protein
AENLWVTVYYGVPVWEDADTPLFCASDAKAYSTESHNVWATHACVPTDPSPQEISLDNVTENFNMWKNNMVEQMHEDIISLWDESLKPCVKLTPLCVTLNCTNVNNSSATNNSMVDDREGLKNCSFNITTELRDKKKQEHALFYRLDIVPINGNSNSNSSVGDYRLINCNVSTCKQACPKMSFDPIPIHYCAPAGFAILKCRDKKFNGTGSCKNVSTVQCTHGIKPVISTQLLLNGSVAEEEIMIRSENFTNNAKNIIVQFNKTIDIMCTRPNNNTRKSISLGPGQAIYATGDIIGNIRQAHCNISGADWGNMIRNVSEKLKEIFNKTTITFKASAGGDLEITTHSFNCRGEFFYCDTSDLFNSSRFNNSSNDTNDTITLPCKIKQIVRMWQRVGQCMYAPPIAGNITCRSNITGLLLTRDGGGNNTNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1102 - protein, 803 aa, Artificial Sequence
  Recombinant HIV protein
AENLWVTVYYGVPVWEDADTTLFCASDAKAYSTESHNVWATHACVPTDPNPQEIPLKNVTENFNMWKNNMVEQMHEDIISLWDESLKPCVKLTPLCVTLICTNVTSNSTNSTNGVTNNSTVDYREQLKNCSFNITTEIRDKQRKEYALFYRLDIVPINDNEKNDTYRLINCNVSTCKQACPKVTFDPIPIHYCAPAGFAILKCRDKKFNGTGPCKNVSTVQCTHGIKPVISTQLLLNGSLAEGDIMIRSENITDNAKTIIVQLKTAVNITCTRPSNNTRKSIRFGPGQAFYATDEIIGDIRQAHCNISKTEWEDMKRNVSDKLKALFNNKTIIFKSSSGGDLEITTHSFNCRGEFFYCNTSGLFNTSGLFNNNSNDSSGNITLPCKIKQIVRMWQRVGQCMYAPPIAGNITCRSRITGLLLVRDGGKSNETNGTETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1103 - protein, 799 aa, Artificial Sequence
  Recombinant HIV protein
AENLWVTVYYGVPVWTEAKTTLFCASDAKAYEKEVHNVWATHACVPTDPNPQEIFLKNVTENFNMWKNDMVDQMHEDIISLWDQSLKPCVKLTPLCVTLNCVTYNNSMNSSATYNNSMNGEIKNCSFNTTTELRDKKQKVYALFYRTDVVPLNNNNNNSEYILINCNTSTCTQACPKVSFDPIPIHYCAPAGYAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRCMYAPPIEGNITCNSNITGLLLTRDGGGNVTEINRTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1104 - protein, 798 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1105 - protein, 798 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1106 - protein, 790 aa, Artificial Sequence
  Recombinant HIV protein
AENLWVTVYYGVPVWREAKATLFCASDAKAYDTEVHNVWATHACVPTDPNPQEIILENVTENFNMWKNNMVEQMHEDIISLWDQSLKPCVKLTPLCVTLNCTDVTVNGTIVKVNSTGMKNCSFNITTEIRDKKKKESALFYRLDIVPLDESSDSSSNYSEYRLISCNTSTCTQACPKVTFDPIPIHYCAPAGYAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRCIYAPPIAGNITCTSDITGLLLTRDGGSDGNSTKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1107 - protein, 796 aa, Artificial Sequence
  Recombinant HIV protein
AENLWVTVYYGVPVWREAKTTLFCASDAKSYEKEVHNVWATHACVPTDPNPQELVLKNVTENFNMWKNDMVDQMHEDIISLWDQSLKPCVKLTPLCVTLNCSDAKVNINATYNGTREEIKNCSFNATTELRDKKKKEYALFYRLDIVPLNKEGNNNSEYRLINCNTSVCTQACPKVTFDPIPIHYCAPAGYAILKCNNKTFNGTGPCNNVSTVQCTHGIKPVVSTQLLLNGSLAEEEIIIRSENLTDNVKTIIVHLNESVEINCTRPNNNTRKSIRIGPGQTFYATGDIIGDIRQAHCNISEIKWEKTLQRVSEKLREHFNKTIIFNQSSGGDLEITTHSFNCGGEFFYCNTSDLFFNKTFDETYSTGSNSTNSTITLPCRIKQIINMWQEVGRCMYASPIAGEITCKSNITGLLLTRDGGGNNSTEETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1108 - protein, 804 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNISRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1109 - protein, 818 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKKKEYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1110 - protein, 799 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1111 - protein, 784 aa, Artificial Sequence
  Recombinant HIV protein
AENLWVTVYYGVPVWKDAETTLFCASDAKAYETEAHSVWATHACVPTDPNPQEIHLENVTENFNMWKNNMVEQMHTDVISIWDQSLKPCVKLTPLCVTLDCSTYNNTHNISKEMKICSFNMTTELRDKKRKVNVLFYKLDLVPLTNSSNTTNYRLISCNTSTCTQACPKVSFDPIPIHYCAPAGFAILKCNNKTFNGTGPCNNVSTVQCTHGIKPVVSTQLLLNGSLAEEEIIIRFENLTDNVKIIIVQLNETINITCTRPNNNTRKSIRIGPGQSFYATGEIVGNIREAHCNISASKWNKTLERVRTKLKEHFPNKTIEFEPSSGGDLEITTHSFNCGGEFFYCNTSGLFNSAINGTLTSNVTLPCRIKQIINMWQEVGRCMYAPPIAGNITCKSNITGLLLTRDGGENSSSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1112 - protein, 784 aa, Artificial Sequence; identical to SEQ ID NO: 1099
  Recombinant HIV protein

SEQ ID NO: 1113 - protein, 803 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLNCTDYLGNATNTTSSSGGAMEGGEIKNCSFNITTSMRDKMQKEYALFYKLDVVSIDNDNASTNYRLISCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1114 - protein, 640 aa, Artificial Sequence
  Recombinant HIV protein
AENLWVTVYYGVPVWKEASTTLFCASDAKAYEAEAHNIWATHACVPTDPNPQEIEIKNVTENFNMWKNDMVEQMHEDIISLWDQSLQPCVKLTPLCVTLNCSNVDNSNKGNATNTTVASEAGMNTTVAPEAGMKNCSFNITTEVKDKKKLVYAHFYNLDVVQLDGNTNSYRLIHCNTSACTRACPKITFEPIPIHYCAPAGFAILRCNNKMFNGTGPCNNVSTVQCTHGIKPVVSTQLLLNGSLAEEGVIIRSENLTDNTKTIIVQLNESVIINCTRPNNNTRQGVRIGPGQALFTNRVIGNIRLAYCNISRKDWNKTLRQVAEKLGNLYNKTKIIFEPSSGGDPEIVTHSFNCGGEFFYCSTSKLFNETIDLNNTYNASIENNTIITLPCRIKQIINMWQGVGKCIYAPPIEGLIKCTSNITGILLTRDGGRDNSSSNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1115 - protein, 630 aa, Artificial Sequence
  Recombinant HIV protein
AENLWVTVYYGVPVWKEASPTLFCASDAKAYDTEVHNVWATYACVPTDPNPQELVMENVTENFNMWKNDMVEQMHQDIISLWDEGLKPCVKLTPLCVTLHCSNVVTSNSNVTSNSTDASKVNKDIIGQMKNCSFNITTEVRDKKKKAYALFYRLDIVPLTADNSSGEYRLINCNTSTCTQACPKVSFDPIPLHYCAPAGYAILKCNDKTFNGTGPCKNVSTVQCTHGIKPVVSTQLLLNGSIAEDKTIIRSENLTNNAKIIIVQLNEPVEINCTRPNNNTRQSIRIGPGQAFYATGEIIGDIRQAHCNISGDRWNKTLESVKERLQKQFPNKTILFAPSSGGDLEITTHSFNCRGEFFYCNTSKLFNTTGLSDNATLTIPCRIKQIINMWQEVGRCMYAPPIKGIITCRSNITGLLLTRDGGTNNTNNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1116 - protein, 635 aa, Artificial Sequence
  Recombinant HIV protein
AENLWVTVYYGVPVWKDAETTLFCASDAKAHDTEKHNVWATHACVPTDPNPQEIHLENVTENFNMWKNNMVDQMHTDIISLWDQSLKPCVQLTPLCVTLNCNNVVTTNNNTNITSEMREEIRNCSFNVTTEQRDKKQKVYSLFYRLDIVQMNEGNNSSNNSANEYRLINCNTSACTQACPKVSFQPIPIHYCAPAGFAILKCRDKEFNGTGVCKNVSTVQCTHGIKPVVSTQLLLNGSLAEEKVMIRTENITDNAKTIIVQLNKTVTINCTRPGNNTRKSIRIGPGQAFYATGDIIGGIRQAHCNVSRKDWNDTLQRVVEQLGNHFNKTIIFDKPSGGDIEITTHSFNCGGEFFYCNTSGLFNSTWKFNGTWNSTDLESNNTVITLPCRIKQIINMWQRVGQCMYAPPIKGVIRCESSITGLLLTRDGGENNSTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1117 - protein, 645 aa, Artificial Sequence
  Recombinant HIV protein
AENLWVTVYYGVPVWKEATTTLFCASDAKAYNPEMHNVWATHACVPTDPNPQEMVLENVTENFNMWENNMVEQMHEDIISLWDQSLKPCVKLTPLCVTLNCRNVNITDITTVDKPIVGDIQNCSFNVTTEINDRKKKMHALFYRLDVVPLNKRNSSTNNNSNNESTMDYRLINCNTSACTQACPKVSFEPIPIHYCAPAGYAILKCNSKTFNGTGPCTNVSTVQCTHGIRPVVSTQLLLNGSLAEEEIIVRSENVTNNAKTIIVHLNESVQINCTRPNNNTRESIRIGPGQALYANGDIIGDIRQAHCNISRGEWNKTLQQVAEKLGNLFNKTEIIFSPSSGGDPEITTHSFNCGGEFFYCNTTGLFNDSKWQHNNSEWEETSKRMNSPEANITLQCRIKQIVNMWQGVGRCMYAPPIRGVIKCTSNITGLLLTRDGGLNTSNNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1118 - protein, 649 aa, Artificial Sequence
  Recombinant HIV protein
AENLWVTVYYGVPVWKEATTTLFCASDAKAYKAEAHNIWATHACVPTDPNPQEIVLGNVTENFNMWKNDMVEQMHEDIISLWEQSLKPCVKLTPLCVTLNCTNVTATNATATSQNSTDGSNKTVNTDTGMKNCSFNVTTELKDKKRQDYALFYKLDVVQIDDKNTNGTNTNYRLINCNTSACTQACPKITFEPIPIHYCAPAGYAILKCNNKTFNGTGPCKNVSTVQCTHGIRPVVSTQLLLNGSLAEEEIVIRSENLTNNAKIIIVQLNEAVTINCTRPSNNTRRSVRIGPGQAIYSTGQIIGDIRKAHCNISRKEWNSTLQQVTKKLGSLFNTTKIIFNASSGGDPEITTHSFNCNGEFFYCNTAGLFNSTWNRTNSEWINSKWTNKTEDVNITLQCRIKQIINMWQGVGKCMYAPPVSGIIRCSSNITGLLLTRDGGGADNNRQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1119 - protein, 635 aa, Artificial Sequence
  Recombinant HIV protein
AENLWVTVYYGVPVWKEATTTLFCASEAKAYDTEVHNVWATHACVPTDPNPQEVELGNVTENFNMWKNDMVEQMHEDIISLWDQSLKPCVRLTPLCVTLDCTNVNNTTNTNNTTNTNSSKIEGGEMKNCSFNITTERGDKKQKEYALLYRTDIVSIENTSSSYRLISCNTSVCTQACPKVTFEPIPIHYCAPAGFAILKCNEDKFNGTGPCKNVSTVQCTHGIRPTVSTQLLLNGSLAKEEVIIRSANLSDNAKIIIVQLKDPVEINCTRPNNNTRKSIRLGPGRAFYATGDIIGDIRQAHCNISRAKWNDTLREIAKKLAEQFNNRTIVFNQSSGGDPEIVMHSFNCAGEFFYCDTSQLFNSTWNSNSTWNDTNNNNSTEKIILSCRIRQIINRWQEVGKCMYAPPISGPIKCSSNITGLLLARDGGNETNVTETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1120 - protein, 634 aa, Artificial Sequence
  Recombinant HIV protein
AENLWVTVYYGVPVWREATTTLFCASDAKAYDTEVHNVWATHACVPTDPNPQEVVLGNVTENFNMWKNNMVDQMHEDIISLWDESLKPCVKLTPLCVTLNCTNVNITKNTTNPTSSSWGMMEKGEIKNCSFYITTEIRNKKKKEYALFNRLDVVPIENTNNTKYRLISCNTSVCTQACPKVSFQPIPIHYCVPAGFAMLKCNNKTFNGSGPCTNVSTVQCTHGIRPVVSTQLLLNGSLAEEDIVIRSENFTDNAKTIIVQLNESVVINCTRPNNNTRRRLRIGPGRAFYARRNIIGDIRQAHCNISRAKWNNTLQQIVIKLREKFRNKTIAFNQSSGGDPEIVMHSFNCGGEFFYCNTAQLFNSTWNVTGGTNGTEGNDIITLQCRIKQIINMWQKVGKCMYAPPITGQIRCSSNITGLLLTRDGGNSTETETEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1121 - protein, 622 aa, Artificial Sequence
  Recombinant HIV protein
AENLWVTVYYGVPVWKEATTTLFCASDAKSYKEEAHNIWATHACVPTDPNPRELIIENVTENFNMWKNNMVEQMHEDIISLWDQSLKPCVKLTPLCVTLNCTNVRKNNTINATGIEMKNCSFNLTTEIRDRKKQVHALFYKLDVVPIDDNNSTNTSYRLINCNTSACTQACPKVTFEPIPIHYCAPAGYAILKCNNKKFNGTGPCNNVSTVQCTHGIRPVVSTQLLLNGSLAEEDIIIRSENLTNNAKIIIVQLNESVTINCTRPYNNTRRGVRIGPGRAYYTTDIIGDIRQAHCNISGAEWNKTLHRVAKKLRDLFKKTTIIFKPSSGGDPEITTHSFNCRGEFFYCNTTRLFNSIWGNNSTGVDESITLPCRIKQIINMWQGVGKCMYAPPIEGLISCSSNITGLLLTRDGGGNESSQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1122 - protein, 634 aa, Artificial Sequence
  Recombinant HIV protein
AENLWVTVYYGVPVWKEATTTLFCASDAKAYDTEVHNVWATHACVPTDPNPQEVALENVTENFNMWKNNMVEQMHEDIISLWDQSLKPCVKLTPLCVTLNCTNVRNATSRNVTNTTSSSRGMVGGGEMKNCSFNITTEIRGKKQKEYALFYELDIVPIDNKIDRYRLISCNTSVCTQACPKVSFEPIPIHYCAPAGFAILKCKDKKFNGKGPCSNVSTVQCTHGIRPVVSTQLLLNGSLAEEEVVIRSENFTNNAKTIIVQLNESVEINCTRPNNNTRKSIRIGPGRAFYTTGEIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQEVGRCMYAPPIRGQIRCSSNITGLLLTRDGGPEDNKTEVFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1123 - protein, 634 aa, Artificial Sequence
  Recombinant HIV protein
AENLWVTVYYGVPVWKEATTTLFCASDAKAYDTEVHNVWATHACVPTDPNPQEVKMENVTENFNMWKNNVVEQMHEDIISLWDQSLKPCVKLTPLCVTLNCTNVKNATNGNNTNTTSSSGGMMGGGEMKNCSFNITTEIRGKKQKEYALFYELDIVPIDNKIDSYRLISCNTSVCTQACPKVSFEPIPIHYCAPAGFAILKCKDKKFNGKGPCSNVSTVQCTHGIRPVVSTQLLLNGSLAEEEVVIRSENFTNNAKIIVVQLNESVEINCTRPNNNTRKSIRIGPGRAFYTTGEIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQEVGRCMYAPPIRGQIRCSSNITGLLLTRDGGPEDDKTEVFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1124 - protein, 650 aa, Artificial Sequence
  Recombinant HIV protein
AENLWVTVYYGVPVWKEATTTLFCASDAKAYETEVHNVWATHACVPTDPNPQEVKLENVTEDFNVWKNDMVTQMHEDIISLWDQSLKPCVKLTPLCVTLHCTNVNTTCITTNNSTMTNSSNSSTEGNCSSYNYNGREELRNCSFNITTEIQDKKQDYAIFYKLDIVPIKSDNSDNTSYRLINCNTSVCTQACPKISFEPIPIHYCAPAGFAILKCNDKKFSGKGTCNNVSTVQCTHGIRPVVSTQLLLNGSLAEEGVVLRSENFTNNAKTIIVQLKDPVKIECERPNNNTIKSIRLGPGRAWHATGQIIGDIRKAFCTLNSTNWTNTLKQMVEKLREQFENKTIAFNQSTGGDPEIVMHTFNCGGEFFYCNTTQLFNSIWYNTTNSSWNNKTWSNNTITLPCRIKQIINMWQQVGKCIYAPPIKGKIKCISNITGLLLTRDGGDTNNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1125 - protein, 630 aa, Artificial Sequence
  Recombinant HIV protein
AENLWVTVYYGVPVWKEATTALFCASDAKTYDTEVHNVWATHACVPTDPDPQEVELENVTENFNMYKNNMVEQMHEDIINLWDQSLKPCVKLTPLCVTLNCTNVRNATIENVTNPNMKMNKGDIKNCSFHITKERRGKKQTGYALFSKLDLVPVNDSEYILISCNTSTCTQACPKVSFEPIPIHYCAPAGFAILKCKDKKFNGTGPCKNVSTVQCTHGIRPVVSTQLLLNGSLAEEDVVIRCENFTNNAKTIIVQLNESVVINCTRPNNNTRRGIRMGPGRAFLAREQIIGNIRQAHCNLSRTQWSNTLKQTVKKLREQFRNKTIVFNQSSGGDPEIVLHSFNCGGEFFYCNTTQLFNSTWNITRNDNEGSNSTEDIITLPCRIKQIVNLWQEVGKCMYAPPISGQIRCSSNITGLLLTRDGGNTSSEAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1126 - protein, 625 aa, Artificial Sequence
  Recombinant HIV protein
AENLWVTVYYGVPVWKEATTTLFCASDARAYDTEVHNIWATHACVPTDPNPQEVVLGNVTENFNMWINDMVEQMHEDIISLWDQSLKPCVKLTPLCVTLNCSNVNTTNTSSTIEGGEIKNCSFNITTEISTKKKDYAIFNKLDIVPIGNDTTSYILINCNTSVCTQACPKVSFEPIPIHYCTPAGFAILKCNNKTFQGTGPCTNVSTVQCTHGIRPVVSTQLLLNGSLAEEEVVIRSSNFSNNAKVIIVQLNKSVEINCTRPNNNTRKSIRLGPGRAWYATGQIIGNIRQAHCNLSRTEWNNTLKQIVNKLREQYGNKTIIFNQSSGGDLEIVMHSFNCGGEFFYCNTSQLFNSTWNVTGTVNGTTGNGTITLPCSIKQIVNRWQEVGRCIYAPPIRGQIRCSSNITGLLLTRDGGNESTTTETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1127 - protein, 653 aa, Artificial Sequence
  Recombinant HIV protein
AENLWVTVYYGVPVWKDAKTTLFCASDAKAYETEVHNVWATHACVPTDPNPQEIFMENVTEDFNMWKNDMVNQMHEDVISLWDQSLKPCVKLTPLCVTLECGNVSVSSNGTVASNKTYVEEMRNCSFNTTTEISDKKKKEHALFYRLDIVPLDDENSNKNCSKNSGQNCSEYYRLINCNTSACTQACPKVSFDPIPIHYCTPAGYALLKCNNKTFNGTGPCHNVSTVQCTHGIKPVVSTQLLLNGSLAEGEIIIRSENLTNNAKTIIVHLNQSVEIVCTRPNNNTRRSIRIGPGQAFFAHGEIIGDIRQAHCNISRNNWTETLQRVSRKLAEHFPNKTINFTSSSGGDLEITTHSFNCRGEFFYCNTSDLFNSTYMSNGTFRFNGTVFNGTGGDSSINITIPCRIKQIINMWQEVGRCMYAPPIAGNITCKSNITGLLLVRDGGTTNNTNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1128 - protein, 645 aa, Artificial Sequence
  Recombinant HIV protein
AENLWVTVYYGVPVWKEATTTLFCASDAKAYDPEVHNIWATHACVPTDPNPQEVVLGNVTENFNMWKNDMVEQMQEDIISLWDQSLQPCVKLTPLCVNLTCTNVTATNATATNSTVAPAPNSTAARTMTDYEMKNCSFNITTETSTKKTGYAVFYNLDVVPIGKGNDTKSYRLLKCNTSVCTQACPKVSFEPIPLHYCAPAGFAILKCNNKTFSGTGPCTNVSTVQCTHGIRPVVSTQLLLNGSLAEEEVVIRSSNFSNNAKTIIVQLKEPVEINCTRPNNNTRKSMRLGPGRAWYTTGQIIGDIRKAHCNLSSTKWHDTLRQIAKKLSKQFGNKTVVFNQSSGGDPEIVMHSFNCGGEFFYCNTAQLFNSTWNTTKIWGNTTEGNNSTIMLPCKIKQIINLWQEVGKCIYAPPIAGRIRCVSNITGLLLTRDGGHNGNGSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1129 - protein, 629 aa, Artificial Sequence
  Recombinant HIV protein
AENLWVTVYYGVPVWKETTTTLFCASDAKAYDTEVHNVWATHACVPTDPNPQEVVLENVTEDFNMWKNNMVEQMQEDVINLWDQSLKPCVKLTPLCVTLNCKNVNATNTTSSSEGMMERGEIKNCSFNITKEIRNKKQKEYALFYKLDVVPIDNKNNTKYRLISCNTSVCTQACPKVSFEPIPIHYCAPAGFAILKCNNKTFNGKGQCKNVSTVQCTHGIRPVVSTQLLLNGSLAEEKVVIRSDNFTDNAKTIIVQLNESVKINCTRPSNNTRKSIRIGPGRAFYTTGEIIGDIRQAHCNISRAQWNNTLKQIVEKLREQFNNKTIVFTHSSGGDPEIVMHSFNCGGEFFYCNSTQLFNSTWNDTEKSSGTEGNDTIILPCRIKQIINMWQEVGKCMYAPPIKGQIRCSSNITGLLLTRDGGKNESEIEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1130 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKNVNATNTTNDSEGTMERGEIKNCSFNITTEIRDEKQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1131 - protein, 640 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLNCSNVNVTSENSTIMGDREEIKNCSFNMTTELRDKKQKVYSLFYRLDVVQINENQGNSSNNNYSEYRLINCNTSACTQACPKVSFEPIPIHYCAPAGFAILKCKDEEFNGTGPCKNVSTVQCTHGIKPVVSTQLLLNGSTAEKEIKIRSENITNNAKIIIVQLVKPVIINCTRPNNNTRRSVRIGPGQAFYATGDIIGNIRQAYCTVNRTDWNNTLQQVAKQLGKHFENKTIIFTKSSGGDLEITTHSFNCGGEFFYCNTSSLFNSTWSHNNSTLLGSNSTESNETITLPCRIKQIVNMWQRTGQCMYAPPIKGVIMCVSNITGLILTRDGGNDNSTNENETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1132 - protein, 639 aa, Artificial Sequence
  Recombinant HIV protein
AENLWVTVYYGVPVWKEATTTLFCASDAKAYDTEVHNVWATHACVPTDPNPQEVELVNVTENFNMWKNNMVEQMHEDIISLWDQSLKPCVKLTPLCVTLNCTNVRNTTNTNNNTDNNNSKSEGTIKGGEMKNCSFNITTEIGDKKQKEYALLYKLDIVSIDNDSTSYRLISCNTSVCTQACPKISFEPIPIHYCAPAGFAILKCNDKKFSGKGSCKNVSTVQCTHGIRPVVSTQLLLNGSLAEEEVVIRSENFTDNAKTIIVHLNESVQINCTRPNYNKRKRIRIGPGRAFYTTKNIKGTIRQAHCNISRAKWNDTLRQIVSKLKEQFKNKTIVFNPSSGGDPEIVMHSFNCGGEFFYCNTSPLFNSTWNSNNTWNNTTGSNNNITLQCKIKQIINMWQKVGKCMYAPPIEGQIRCSSNITGLLLTRDGGEDTDTNDTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1133 - protein, 647 aa, Artificial Sequence
  Recombinant HIV protein
AENLWVTVYYGVPVWKEATTTLFCASDAKSYEAEAHNIWATHACVPTDPNPREIKLENVTEHFNMWKNNMVEQMHKDIISLWDQSLKPCVKLTPLCVTLNCTNVKNETIAKTFNKNKTMKNETMKNLNDTIKNLNETMTNCSFRVTTELRDKKKQVHALFYRLDVVKTDGGNNSYRLINCNTSVCTQACPKITFEPIPIHYCAPAGFAILKCNNKTFNGTGPCKNVSTVQCTHGIKPVVSTQLLLNGSLAEEETIIRSENITNNAKTIIVQLNESVTINCTRPSNNTRQSIRIGPGQAFYTTEVIGNIRLAFCEINGTEWNKTLQQVAKKLGNLFSNKTIIFKPSSGGDLEITTHSFNCRGEFFYCNTSKLFNSTWDNDTWSDTTNSTGGNASKIILPCRIKQIINMWQEVGKCMYAPPIRGAINCLSNVTGLLLTRDGGNTNSTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1134 - protein, 646 aa, Artificial Sequence
  Recombinant HIV protein
AENLWVTVYYGVPVWKEATTTLFCASDAKAYNTEVHNVWATHACVPTDPNPQEVGLENVTENFNMWKNNMVEQMHEDIISLWDQSLKPCVKLTPLCVTLNCSNVRNATNTTNPTVSSRVIKKEMMGEVKNCSFNVTTEIRDRKQKVYALFYRPDVVPIQDHTIENNNTIENNTTYRLISCNTSVCTQACPKISFEPIPIHYCTPAGFAILKCNDKKFNGSGPCTNVSTVQCTHGIRPVVSTQLLLNGSRAEEEVIIRSENFTNNAKTIIVQLNKTVEINCTRPNNNTRKSIRIGPGRAFYATGDIIGDIRQAHCNLSRAEWNKTLKYISTKLREQFGNKTIIFNGSSGGDPEIVTHSFNCGGEFFYCNTTKLFNSTWDANGNCTGCDESDGNNTITLPCRIKQIVNMWQEVGKCMYAPPIKGLIKCTSNITGLLLTRDGGANNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1135 - protein, 622 aa, Artificial Sequence; identical to SEQ ID NO: 983
  Recombinant HIV protein

SEQ ID NO: 1136 - protein, 648 aa, Artificial Sequence
  Recombinant HIV protein
AENLWVTVYYGVPVWKEATTTLFCASDAKAYETEKHNVWATHACVPTDPNPQEVVLGNVTENFNMWKNNMVEQMHEDIISLWDESLKPCVKLTPLCVTLNCTNVVKTSYANKTSNETYKTSNETFGEIKNCSFSVPTEIKDKKQNVYALFYKLDVIPIDDNNNSSKNNNGSYSSYRLINCNTSVCTQACPKVSFEPIPIHYCAPAGFAILKCNNKTFNGTGPCTNVSTVQCTHGIRPVVSTQLLLNGSLAEEEVVIRSENFTNNAKTIIVHLKKSVEINCTRPGNNTRKSIRIGPGRAFYATGDIIGDIRQAHCNLSSVQWNDTLKQIVIKLGEQFGTNKTIAFNQSSGGDPEIVMHSFNCGGEFFYCNTTQLFNSTWEFHGNWTRSNFTESNSTTITLPCRIKQIVNMWQEVGKCMYAPPIRGQIRCSSNITGLLLTRDGGVNGTRETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1137 - protein, 628 aa, Artificial Sequence
  Recombinant HIV protein
AENLWVTVYYGVPVWKEATTTLFCASDAKAYDTEVHNVWATHACVPTDPNPQEIVLENVTENFNMWKNNMVEQMHEDIISLWDQSLKPCVKLTPLCVTLHCTNVKNATNTKSSNWKEMDRGEIKNCSFKVTTEIRNKKQKEYALFYKLDVVPIDNDNTSYKLINCNTSVCTQACPKVSFEPIPIHYCAPAGFAILKCNDKKFNGSGPCTNVSTVQCTHGIRPVVSTQLLLNGSLAEEGVVIRSENFTDNAKTIIVQLKESVEINCTRPNNNTRKSIRIGPGRAFYATGDIIGDIRQAHCNISGEKWNNTLKQIVTKLQAQFGNKTIVFKQSSGGDPEIVMHSFNCGGEFFYCNSTQLFNSTWNNTIGPNNTNGTITLPCRIKQIINRWQEVGKCMYAPPIRGQIRCSSNITGLLLTRDGGKEISNTTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1138 - protein, 631 aa, Artificial Sequence
  Recombinant HIV protein
AENLWVTVYYGVPVWKEATTTLFCASDAKAYDTEKHNVWATHACVPTDPNPQEIVLKNVTENFNMWKNNMVEQMHEDIISLWDQSLKPCVKLTPLCVTLNCTNVFGNTTNNSSREAMMKKCSFNITTEIRDKKQKEYALFYKTDVVPIDNDNTSYRMISCNTSVCTQACPKISFEPIPIHFCAPAGFAILKCFNKTFNGTGPCTNVSTVQCTHGIRPVVSTQLLLNGSLAEEEVVIRSENLTDNTKIIIVQLNKSVVINCTRPNNNTRKSIRIGPGRAFYATGGVIGDIRQAHCNISRKDWYEALQQIAIKLREQFENRTIAFNRSSGGDPEIVTHSFNCAGEFFYCNTTQLFNNTWNGTGWSDNSENTTGNGTITLPCRIKQIVNLWQEVGKCMYAPPIRGLIRCSSNITGLLLTRDGGNNTTTNGTQTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1139 - protein, 656 aa, Artificial Sequence
  Recombinant HIV protein
AENLWVTVYYGVPVWKDAETTLFCASDAKGYEREAHNIWATHACVPTDPNPQELHLENVTEDFNMWKNTMVEQMHEDIISLWDQSLKPCVKITPLCVTLNCINVSFNSSNSSLNNSSNSSLNNSSLNSSSNIGEMQMKNCSFNVTTELRDKKKKEYALFYRQDIVQINENKNNSNQSKENNSSQSHYMLINCNTSTCAQACPKVSFQPIPIHYCAPAGFAILKCNDKGFSGTGKCKNVSTVQCTHGIKPVVTTQLLLNGSTAEGNVTIRSENITNNAKTIIVQLVKPVKINCTRPGNNTRKSVRIGPGQALYATGNIVGDIRQAHCNVSGKEWNDTLSQVVTQLRKYFNNTIIKFNSSSGGDVEITTHSFNCGGEFFYCDTSSLFNSTWENNTNSNWDNSTITLQCRIKQFINMWQRVGRCMYAPPIPGVIRCESNITGILLTRDGGVNNDTNTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1140 - protein, 628 aa, Artificial Sequence
  Recombinant HIV protein
AENLWVTVYYGVPVWKDADTTLFCASDAKAYDKEVHNVWATHACVPTDPNPQEIKLTNVTENFNMWKNHMVEQMHTDIISLWDQSLKPCVKLTPLCVTLNCTNVTTNGTIEDGAKNCSFNMTTELRDKKKKVYSLFYKLDIVKIRENNNSDNYTYRLINCNTSTCTQACPKVTFEPIPIHYCAPAGFAILKCTDKKFNGTGPCSNVSSVQCTHGIKPVVSTQLLLNGSLAEEGIIIRSEDITNNAKTIIVQLTKPVNITCVRPNNNTRRGIRIGPGQAFYARDSIIGDIRQAYCNVSKAEWNETLQQVAKKLRDNYGNKTIIFTSSSGGDLEITTHSFNCGGEFFYCNTSSLFNSTWNWNGTSIQGPNDTQSNGTITLPCRIKQIVNMWQRAGQCMYAPPIPGIIKCESNITGLLLVRDGGNNSGSNETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1141 - protein, 631 aa, Artificial Sequence
  Recombinant HIV protein
AENLWVTVYYGVPVWKEATTTLFCASDAKAYKAEAHNIWATHACVPTDPNPREIQLENVTENFNMWKNNMVEQMHEDVISLWDQSLKPCVKLTPLCVTLNCINVKNENETKGNKTVDPDKDIGMKNCSFNVTTEVRDKKKQVYALFYKLDVVQMNDNNTNTSYRLINCNTSACTQECPKVTFEPIPIHYCAPAGFAILKCNNKMFNGTGPCNNVSTVQCTHGIRPVVSTQLLLNGSLAEEEIIIRSENITNNAKIIIVHLNESVVINCTRPYNNIRQRTRIGLGQALYTTRRIEDIRRAHCNISEAAWKKTLEQVAKKLKVLFNRTTIDFKPSSGGDPEITTHSFNCGGEFFYCNTSKLFNHSVGENNTLSISNGVNTNITLPCKIKQIVNMWQGVGKCMYAPPIQGLIRCSSNITGLLLTRDGGNTSQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1142 - protein, 609 aa, Artificial Sequence
  Recombinant HIV protein
AENLWVTVYYGVPVWKEAKATLFCASDAKAQETEVHNIWATHACVPTDPNPQEMILENVTENFNMWKNDMVDQMHEDVISLWDQSLKPCIKLTPLCVTLNCTNVTYNGSTIEDVRNCSFNATTEVKNKKQEVNALFNLLDIVPIKSSIYRLTNCNTSACTQACPKVTFDPIPIHYCAPAGYAILKCNNKTFNGKGPCNNVSTVQCTHGIKPVVSTQLLLNGSLAEEDIIIRSENLTNNVKTIIVHLKEPVEIVCTRPGNNTRKSVRIGPGQAFYATGAIIGDIRKAHCNISKKAWNDTLHKVEGKLRELYNKSIKFEPSSGGDLEITTHSFNCRGEFFYCNTTKLFHEGSRKNDNDTITLPCRIKQFINMWQEVGRCMYAPPIAGNITCNSSITGILLVRDGGTNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1143 - protein, 640 aa, Artificial Sequence
  Recombinant HIV protein
AENLWVTVYYGVPVWKEAETTLFCASDAKAYEAEAHNIWATHACVPTDPNPQEIEIKNVTENFNMWKNDMVEQMHEDIISLWDQSLQPCVKLTPLCVTLNCSNVDNSNKGNATNTTVASEAGMNTTVDMRGGMKNCSFNITTEVKDKKKLVYAHFYNLDVVQLDGNNNEYRLIHCNTSACTRACPKITFEPIPIHYCAPAGFAILRCNNKMFNGTGPCNNVSTVQCTHGIKPVVSTQLLLNGSLAEEGVIIRSENLTDNAKTIIVQLNESVQINCTRPNNNTRQGVRIGPGQALFTNRVIGNIRLAYCNISRADWNETLRQVAEKLGNHYNKTKIRFANSSGGDLEITTHSFNCGGEFFYCSTSKLFNSTIDLNNTYNASIESNTIITLPCRIKQIINMWQGVGQCIYAPPIEGVIRCVSNITGILLTRDGGRDNSSSNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1144 - protein, 630 aa, Artificial Sequence
  Recombinant HIV protein
AENLWVTVYYGVPVWKEAEPTLFCASDAKAYDTEVHNVWATYACVPTDPNPQELVMENVTENFNMWKNDMVEQMHQDIISLWDEGLKPCVKLTPLCVTLHCSNVVTSNSNVTSNSTDASKVNKDMRGQMKNCSFNITTEVRDKKKKAYALFYRLDIVPLTADNSNGEYRLINCNTSTCTQACPKVSFEPIPLHYCAPAGFAILKCNDKTFNGTGPCKNVSTVQCTHGIKPVVSTQLLLNGSIAEDKTIIRSENLTNNAKIIIVQLNEPVQINCTRPNNNTRQSIRIGPGQAFYATGEIIGDIRQAHCNISGARWNETLESVKERLQKHFPNKTIRFANSSGGDLEITTHSFNCRGEFFYCNTSKLFNSTGLSSNATLTIPCRIKQIINMWQEVGQCMYAPPIKGVIRCVSNITGLLLTRDGGTNNTNNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1145 - protein, 635 aa, Artificial Sequence
  Recombinant HIV protein
AENLWVTVYYGVPVWKDAETTLFCASDAKAHDTEKHNVWATHACVPTDPNPQEIHLENVTENFNMWKNNMVDQMHTDIISLWDQSLKPCVQLTPLCVTLNCNNVVTTNNNTNITSDMRGEIRNCSFNVTTEQRDKKQKVYSLFYRLDIVQMNEGNNSSNNSNNEYRLINCNTSACTQACPKVSFEPIPIHYCAPAGFAILKCRDKEFNGTGVCKNVSTVQCTHGIKPVVSTQLLLNGSLAEEKVMIRTENITDNAKTIIVQLNKTVQINCTRPGNNTRKSIRIGPGQAFYATGDIIGGIRQAHCNVSRADWNETLQRVVEQLGNHFNKTIRFANPSGGDLEITTHSFNCGGEFFYCNTSGLFNSTWKFNGTWNSTDLESSNTVITLPCRIKQIINMWQRVGQCMYAPPIKGVIRCVSSITGLLLTRDGGENNSTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1146 - protein, 645 aa, Artificial Sequence
  Recombinant HIV protein
AENLWVTVYYGVPVWKEAETTLFCASDAKAYNPEMHNVWATHACVPTDPNPQEMVLENVTENFNMWENNMVEQMHEDIISLWDQSLKPCVKLTPLCVTLNCRNVNITDITTVDKDMRGDIQNCSFNVTTEINDRKKKMHALFYRLDVVPLNKRNSSTNNNSNNESNMEYRLINCNTSACTQACPKVSFEPIPIHYCAPAGFAILKCNSKTFNGTGPCTNVSTVQCTHGIKPVVSTQLLLNGSLAEEEIIVRSENVTNNAKTIIVHLNESVQINCTRPNNNTRESIRIGPGQALYANGDIIGDIRQAHCNISRAEWNETLQQVAEKLGNHFNKTEIRFANSSGGDLEITTHSFNCGGEFFYCNTTGLFNDSKWQHNNSEWEETSKRMNSSEANITLQCRIKQIVNMWQGVGQCMYAPPIRGVIRCVSNITGLLLTRDGGLNTSNNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1147 - protein, 649 aa, Artificial Sequence
  Recombinant HIV protein
AENLWVTVYYGVPVWKEAETTLFCASDAKAYKAEAHNIWATHACVPTDPNPQEIVLGNVTENFNMWKNDMVEQMHEDIISLWEQSLKPCVKLTPLCVTLNCTNVTATNATATSQNSTDGSNKTVDMRGGMKNCSFNVTTELKDKKRQDYALFYKLDVVQIDDKNTNGTNTEYRLINCNTSACTQACPKITFEPIPIHYCAPAGFAILKCNNKTFNGTGPCKNVSTVQCTHGIKPVVSTQLLLNGSLAEEEIVIRSENLTNNAKIIIVQLNEAVQINCTRPSNNTRRSVRIGPGQAIYSTGQIIGDIRKAHCNISRAEWNETLQQVTKKLGSHFNTTKIRFANSSGGDLEITTHSFNCNGEFFYCNTAGLFNSTWNRTNSEWINSKWTNKTSDVNITLQCRIKQIINMWQGVGQCMYAPPVSGVIRCVSNITGLLLTRDGGGADNNRQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1148 - protein, 635 aa, Artificial Sequence
  Recombinant HIV protein
AENLWVTVYYGVPVWKEAETTLFCASEAKAYDTEVHNVWATHACVPTDPNPQEVELGNVTENFNMWKNDMVEQMHEDIISLWDQSLKPCVRLTPLCVTLDCTNVNNTTNTNNTTNTNSSKDMRGEMKNCSFNITTERGDKKQKEYALLYRTDIVSIENTNSEYRLISCNTSVCTQACPKVTFEPIPIHYCAPAGFAILKCNEDKFNGTGPCKNVSTVQCTHGIKPTVSTQLLLNGSLAKEEVIIRSANLSDNAKIIIVQLKDPVQINCTRPNNNTRKSIRLGPGRAFYATGDIIGDIRQAHCNISRAKWNETLREIAKKLAEHFNNRTIRFANSSGGDLEITMHSFNCAGEFFYCDTSQLFNSTWNSNSTWNDTNNNNSTEKIILSCRIRQIINRWQEVGQCMYAPPISGVIRCVSNITGLLLARDGGNETNVTETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1149 - protein, 634 aa, Artificial Sequence
  Recombinant HIV protein
AENLWVTVYYGVPVWREAETTLFCASDAKAYDTEVHNVWATHACVPTDPNPQEVVLGNVTENFNMWKNNMVDQMHEDIISLWDESLKPCVKLTPLCVTLNCTNVNITKNTTNPTSSSWGMDMRGEIKNCSFYITTEIRNKKKKEYALFNRLDVVPIENTNNTEYRLISCNTSVCTQACPKVSFEPIPIHYCVPAGFAMLKCNNKTFNGSGPCTNVSTVQCTHGIKPVVSTQLLLNGSLAEEDIVIRSENFTDNAKTIIVQLNESVQINCTRPNNNTRRRLRIGPGRAFYARRNIIGDIRQAHCNISRAKWNETLQQIVIKLREHFRNKTIRFANSSGGDLEITMHSFNCGGEFFYCNTAQLFNSTWNVTGGTNGTESNDIITLQCRIKQIINMWQKVGQCMYAPPITGVIRCVSNITGLLLTRDGGNSTETETEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1150 - protein, 622 aa, Artificial Sequence
  Recombinant HIV protein
AENLWVTVYYGVPVWKEAETTLFCASDAKSYKEEAHNIWATHACVPTDPNPRELIIENVTENFNMWKNNMVEQMHEDIISLWDQSLKPCVKLTPLCVTLNCTNVRKNNTINDMRGEMKNCSFNLTTEIRDRKKQVHALFYKLDVVPIDDNNSTNTEYRLINCNTSACTQACPKVTFEPIPIHYCAPAGFAILKCNNKKFNGTGPCNNVSTVQCTHGIKPVVSTQLLLNGSLAEEDIIIRSENLTNNAKIIIVQLNESVQINCTRPYNNTRRGVRIGPGRAYYTTDIIGDIRQAHCNISGAEWNETLHRVAKKLRDHFKKTTIRFANSSGGDLEITTHSFNCRGEFFYCNTTRLFNSIWGNNSTGSDESITLPCRIKQIINMWQGVGQCMYAPPIEGVIRCVSNITGLLLTRDGGGNESSQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1151 - protein, 634 aa, Artificial Sequence
  Recombinant HIV protein
AENLWVTVYYGVPVWKEAETTLFCASDAKAYDTEVHNVWATHACVPTDPNPQEVALENVTENFNMWKNNMVEQMHEDIISLWDQSLKPCVKLTPLCVTLNCTNVRNATSRNVTNTTSSSRGMDMRGEMKNCSFNITTEIRGKKQKEYALFYELDIVPIDNKNDEYRLISCNTSVCTQACPKVSFEPIPIHYCAPAGFAILKCKDKKFNGKGPCSNVSTVQCTHGIKPVVSTQLLLNGSLAEEEVVIRSENFTNNAKTIIVQLNESVQINCTRPNNNTRKSIRIGPGRAFYTTGEIIGDIRQAHCNLSRAKWNETLNKIVIKLREHFGNKTIRFANSSGGDLEITTHSFNCGGEFFYCNSTQLFNSTWNVTEESNNTVSNNTITLPCRIKQIINMWQEVGQCMYAPPIRGVIRCVSNITGLLLTRDGGPEDNKTEVFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1152 - protein, 634 aa, Artificial Sequence
  Recombinant HIV protein
AENLWVTVYYGVPVWKEAETTLFCASDAKAYDTEVHNVWATHACVPTDPNPQEVKMENVTENFNMWKNNVVEQMHEDIISLWDQSLKPCVKLTPLCVTLNCTNVKNATNGNNTNTTSSSGGMDMRGEMKNCSFNITTEIRGKKQKEYALFYELDIVPIDNKNDEYRLISCNTSVCTQACPKVSFEPIPIHYCAPAGFAILKCKDKKFNGKGPCSNVSTVQCTHGIKPVVSTQLLLNGSLAEEEVVIRSENFTNNAKIIVVQLNESVQINCTRPNNNTRKSIRIGPGRAFYTTGEIIGDIRQAHCNLSRAKWNETLNKIVIKLREHFGNKTIRFANSSGGDLEITTHSFNCGGEFFYCNSTQLFNSTWNVTEESNNTVSNNTITLPCRIKQIINMWQEVGQCMYAPPIRGVIRCVSNITGLLLTRDGGPEDDKTEVFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1153 - protein, 650 aa, Artificial Sequence
  Recombinant HIV protein
AENLWVTVYYGVPVWKEAETTLFCASDAKAYETEVHNVWATHACVPTDPNPQEVKLENVTEDFNVWKNDMVTQMHEDIISLWDQSLKPCVKLTPLCVTLHCTNVNTTCITTNNSTMTNSSNSSTEGNCSSYNYDMRGELRNCSFNITTEIQDKKQDYAIFYKLDIVPIKSDNSDNTEYRLINCNTSVCTQACPKISFEPIPIHYCAPAGFAILKCNDKKFSGKGTCNNVSTVQCTHGIKPVVSTQLLLNGSLAEEGVVLRSENFTNNAKTIIVQLKDPVQIECERPNNNTIKSIRLGPGRAWHATGQIIGDIRKAFCTLNSANWTETLKQMVEKLREHFENKTIRFANSTGGDLEITMHTFNCGGEFFYCNTTQLFNSIWYNTTNSSWNNKTWSNNTITLPCRIKQIINMWQQVGQCIYAPPIKGVIRCVSNITGLLLTRDGGDTNNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1154 - protein, 631 aa, Artificial Sequence
  Recombinant HIV protein
AENLWVTVYYGVPVWKEAETALFCASDAKTYDTEVHNVWATHACVPTDPDPQEVELENVTENFNMYKNNMVEQMHEDIINLWDQSLKPCVKLTPLCVTLNCTNVRNATIENVTNPNMKDMRGDIKNCSFHITKERRGKKQTGYALFSKLDLVPVNDNSEYILISCNTSTCTQACPKVSFEPIPIHYCAPAGFAILKCKDKKFNGTGPCKNVSTVQCTHGIKPVVSTQLLLNGSLAEEDVVIRCENFTNNAKTIIVQLNESVQINCTRPNNNTRRGIRMGPGRAFLAREQIIGNIRQAHCNLSRAQWSETLKQTVKKLREHFRNKTIRFANSSGGDLEITLHSFNCGGEFFYCNTTQLFNSTWNITRNDNEGSNSSEDIITLPCRIKQIVNLWQEVGQCMYAPPISGVIRCVSNITGLLLTRDGGNTSSEAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1155 - protein, 625 aa, Artificial Sequence
  Recombinant HIV protein
AENLWVTVYYGVPVWKEAETTLFCASDARAYDTEVHNIWATHACVPTDPNPQEVVLGNVTENFNMWINDMVEQMHEDIISLWDQSLKPCVKLTPLCVTLNCSNVNTTNTSSTDMRGEIKNCSFNITTEISTKKKDYAIFNKLDIVPIGNDNTEYILINCNTSVCTQACPKVSFEPIPIHYCTPAGFAILKCNNKTFQGTGPCTNVSTVQCTHGIKPVVSTQLLLNGSLAEEEVVIRSSNFSNNAKVIIVQLNKSVQINCTRPNNNTRKSIRLGPGRAWYATGQIIGNIRQAHCNLSRAEWNETLKQIVNKLREHYGNKTIRFANSSGGDLEITMHSFNCGGEFFYCNTSQLFNSTWNVTGTVNGTTSNGTITLPCSIKQIVNRWQEVGQCIYAPPIRGVIRCVSNITGLLLTRDGGNESTTTETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1156 - protein, 653 aa, Artificial Sequence
  Recombinant HIV protein
AENLWVTVYYGVPVWKDAETTLFCASDAKAYETEVHNVWATHACVPTDPNPQEIFMENVTEDFNMWKNDMVNQMHEDVISLWDQSLKPCVKLTPLCVTLECGNVSVSSNGTVASNKDMRGEMRNCSFNTTTEISDKKKKEHALFYRLDIVPLDDENSNKNCSKNSGQNCNEEYRLINCNTSACTQACPKVSFEPIPIHYCTPAGFALLKCNNKTFNGTGPCHNVSTVQCTHGIKPVVSTQLLLNGSLAEGEIIIRSENLTNNAKTIIVHLNQSVQIVCTRPNNNTRRSIRIGPGQAFFAHGEIIGDIRQAHCNISRANWTETLQRVSRKLAEHFPNKTIRFANSSGGDLEITTHSFNCRGEFFYCNTSDLFNSTYMSNGTFRFNGTVFNGTGGDSSINITIPCRIKQIINMWQEVGQCMYAPPIAGVIRCVSNITGLLLVRDGGTTNNTNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1157 - protein, 645 aa, Artificial Sequence
  Recombinant HIV protein
AENLWVTVYYGVPVWKEAETTLFCASDAKAYDPEVHNIWATHACVPTDPNPQEVVLGNVTENFNMWKNDMVEQMQEDIISLWDQSLQPCVKLTPLCVNLTCTNVTATNATATNSTVAPAPNSTAARTDMRGEMKNCSFNITTETSTKKTGYAVFYNLDVVPIGKGNDNKEYRLLKCNTSVCTQACPKVSFEPIPLHYCAPAGFAILKCNNKTFSGTGPCTNVSTVQCTHGIKPVVSTQLLLNGSLAEEEVVIRSSNFSNNAKTIIVQLKEPVQINCTRPNNNTRKSMRLGPGRAWYTTGQIIGDIRKAHCNLSSAKWHETLRQIAKKLSKHFGNKTVRFANSSGGDLEITMHSFNCGGEFFYCNTAQLFNSTWNTTKIWGNTTEGSNSTIMLPCKIKQIINLWQEVGQCIYAPPIAGVIRCVSNITGLLLTRDGGHNGNGSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1158 - protein, 629 aa, Artificial Sequence
  Recombinant HIV protein
AENLWVTVYYGVPVWKETETTLFCASDAKAYDTEVHNVWATHACVPTDPNPQEVVLENVTEDFNMWKNNMVEQMQEDVINLWDQSLKPCVKLTPLCVTLNCKNVNATNTTSSSEGMDMRGEIKNCSFNITKEIRNKKQKEYALFYKLDVVPIDNKNNTEYRLISCNTSVCTQACPKVSFEPIPIHYCAPAGFAILKCNNKTFNGKGQCKNVSTVQCTHGIKPVVSTQLLLNGSLAEEKVVIRSDNFTDNAKTIIVQLNESVQINCTRPSNNTRKSIRIGPGRAFYTTGEIIGDIRQAHCNISRAQWNETLKQIVEKLREHFNNKTIRFANSSGGDLEITMHSFNCGGEFFYCNSTQLFNSTWNDTEKSSGTESNDTIILPCRIKQIINMWQEVGQCMYAPPIKGVIRCVSNITGLLLTRDGGKNESEIEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1159 - protein, 628 aa, Artificial Sequence
  Recombinant HIV protein
AENLWVTVYYGVPVWKEAETTLFCASDAKAYDTEVHNVWATHACVPTDPNPQEVVLENVTEHFNMWKNNMVEQMQEDIISLWDQSLKPCVKLTPLCVTLNCKNVNATNTTNDSEGTDMRGEIKNCSFNITTEIRDEKQKEYALFYKLDVVPIDNNNTEYRLISCDTSVCTQACPKISFEPIPIHYCAPAGFAILKCNDKTFNGKGPCKNVSTVQCTHGIKPVVSTQLLLNGSLAEEEVVIRSDNFTNNAKTIIVQLKESVQINCTRPNNNTRKSIRIGPGRAFYTTGEIIGDIRQAHCNISRAKWNETLKQIVIKLREHFENKTIRFANSSGGDLEITMHSFNCGGEFFYCNSTQLFNSTWNNNTEGSNNTSGNTITLPCRIKQIINMWQEVGQCMYAPPIRGVIRCVSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1160 - protein, 640 aa, Artificial Sequence
  Recombinant HIV protein
AENLWVTVYYGVPVWRDAETTLFCASDAKAYETEKHNVWATHACVPTDPNPQEIHLDNVTEKFNMWKNNMVEQMHTDIISLWDQSLKPCVKLTPLCVTLNCSNVNVTSENSTIMDMRGEIKNCSFNMTTELRDKKQKVYSLFYRLDVVQINENQGNSSNNNNSEYRLINCNTSACTQACPKVSFEPIPIHYCAPAGFAILKCKDEEFNGTGPCKNVSTVQCTHGIKPVVSTQLLLNGSTAEKEIKIRSENITNNAKIIIVQLVKPVQINCTRPNNNTRRSVRIGPGQAFYATGDIIGNIRQAYCTVNRADWNETLQQVAKQLGKHFENKTIRFANSSGGDLEITTHSFNCGGEFFYCNTSSLFNSTWSHNNSTLLGSNSTESNETITLPCRIKQIVNMWQRTGQCMYAPPIKGVIRCVSNITGLILTRDGGNDNSTNENETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1161 - protein, 639 aa, Artificial Sequence
  Recombinant HIV protein
AENLWVTVYYGVPVWKEAETTLFCASDAKAYDTEVHNVWATHACVPTDPNPQEVELVNVTENFNMWKNNMVEQMHEDIISLWDQSLKPCVKLTPLCVTLNCTNVRNTTNTNNNTDNNNSKSEGTDMRGEMKNCSFNITTEIGDKKQKEYALLYKLDIVSIDNDNTEYRLISCNTSVCTQACPKISFEPIPIHYCAPAGFAILKCNDKKFSGKGSCKNVSTVQCTHGIKPVVSTQLLLNGSLAEEEVVIRSENFTDNAKTIIVHLNESVQINCTRPNYNKRKRIRIGPGRAFYTTKNIKGTIRQAHCNISRAKWNETLRQIVSKLKEHFKNKTIRFANSSGGDLEITMHSFNCGGEFFYCNTSPLFNSTWNSNNTWNNTTGSNNNITLQCKIKQIINMWQKVGQCMYAPPIEGVIRCVSNITGLLLTRDGGEDTDTNDTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1162 - protein, 647 aa, Artificial Sequence
  Recombinant HIV protein
AENLWVTVYYGVPVWKEAETTLFCASDAKSYEAEAHNIWATHACVPTDPNPREIKLENVTEHFNMWKNNMVEQMHKDIISLWDQSLKPCVKLTPLCVTLNCTNVKNETIAKTFNKNKTMKNETMKNLNDTIKDMRGTMTNCSFRVTTELRDKKKQVHALFYRLDVVKTDGGNNEYRLINCNTSVCTQACPKITFEPIPIHYCAPAGFAILKCNNKTFNGTGPCKNVSTVQCTHGIKPVVSTQLLLNGSLAEEETIIRSENITNNAKTIIVQLNESVQINCTRPSNNTRQSIRIGPGQAFYTTEVIGNIRLAFCEINGAEWNETLQQVAKKLGNHFSNKTIRFANSSGGDLEITTHSFNCRGEFFYCNTSKLFNSTWDNDTWSDTTNSTGGSASKIILPCRIKQIINMWQEVGQCMYAPPIRGVIRCVSNVTGLLLTRDGGNTNSTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1163 - protein, 646 aa, Artificial Sequence
  Recombinant HIV protein
AENLWVTVYYGVPVWKEAETTLFCASDAKAYNTEVHNVWATHACVPTDPNPQEVGLENVTENFNMWKNNMVEQMHEDIISLWDQSLKPCVKLTPLCVTLNCSNVRNATNTTNPTVSSRVIKKDMRGEVKNCSFNVTTEIRDRKQKVYALFYRPDVVPIQDHTIENNNTIENNTEYRLISCNTSVCTQACPKISFEPIPIHYCTPAGFAILKCNDKKFNGSGPCTNVSTVQCTHGIKPVVSTQLLLNGSRAEEEVIIRSENFTNNAKTIIVQLNKTVQINCTRPNNNTRKSIRIGPGRAFYATGDIIGDIRQAHCNLSRAEWNETLKYISTKLREHFGNKTIRFANSSGGDLEITTHSFNCGGEFFYCNTTKLFNSTWDANGNCTGCDESDSNNTITLPCRIKQIVNMWQEVGQCMYAPPIKGVIRCVSNITGLLLTRDGGANNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1164 - protein, 622 aa, Artificial Sequence
  Recombinant HIV protein
AENLWVTVYYGVPVWKDAETTLFCASNAKAYGTEVNIWATHACVPTDPNPQEINLENVTEEFNMWKNNMVEQMHTDIISLWDQGLKPCVKLTPLCVTLDCYNVTKSDKITKDMRGEIKNCSFNITTELRDKKQKVHSLFYRLDVVPMGGKNNSEYRLINCNTSACTQACPKVTFEPIPIHYCAPAGFAILKCNDKEFSGTGPCKNVSSVQCTHGIKPVVSTQLLLNGSLAEEKVRIRSEDITNNAKNIIVQLKTPVQISCTRPNNNTRKSVRIGPGQAFYATDDIIGNIRQAYCTVNRAQWDETLQEVANQLRIHFNKTIRFANSAGGDLEITTHSFNCGGEFFYCDTSGLFNSTWTWNDTVSWQSSDNITLQCRIKQIINMWQRAGQCIYAPPIQGVIRCVSNITGLILTRDGGNNSSPNEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1165 - protein, 648 aa, Artificial Sequence
  Recombinant HIV protein
AENLWVTVYYGVPVWKEAETTLFCASDAKAYETEKHNVWATHACVPTDPNPQEVVLGNVTENFNMWKNNMVEQMHEDIISLWDESLKPCVKLTPLCVTLNCTNVVKTSYANKTSNETYKTSNDMRGEIKNCSFSVPTEIKDKKQNVYALFYKLDVIPIDDNNNSSKNNNGSNSEYRLINCNTSVCTQACPKVSFEPIPIHYCAPAGFAILKCNNKTFNGTGPCTNVSTVQCTHGIKPVVSTQLLLNGSLAEEEVVIRSENFTNNAKTIIVHLKKSVQINCTRPGNNTRKSIRIGPGRAFYATGDIIGDIRQAHCNLSSAQWNETLKQIVIKLGEHFGTNKTIRFANSSGGDLEITMHSFNCGGEFFYCNTTQLFNSTWEFHGNWTRSNFTESSSTTITLPCRIKQIVNMWQEVGQCMYAPPIRGVIRCVSNITGLLLTRDGGVNGTRETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1166 - protein, 628 aa, Artificial Sequence
  Recombinant HIV protein
AENLWVTVYYGVPVWKEAETTLFCASDAKAYDTEVHNVWATHACVPTDPNPQEIVLENVTENFNMWKNNMVEQMHEDIISLWDQSLKPCVKLTPLCVTLHCTNVKNATNTKSSNWKEDMRGEIKNCSFKVTTEIRNKKQKEYALFYKLDVVPIDNDNTEYKLINCNTSVCTQACPKVSFEPIPIHYCAPAGFAILKCNDKKFNGSGPCTNVSTVQCTHGIKPVVSTQLLLNGSLAEEGVVIRSENFTDNAKTIIVQLKESVQINCTRPNNNTRKSIRIGPGRAFYATGDIIGDIRQAHCNISGAKWNETLKQIVTKLQAHFGNKTIRFANSSGGDLEITMHSFNCGGEFFYCNSTQLFNSTWNNTIGPNNSNGTITLPCRIKQIINRWQEVGQCMYAPPIRGVIRCVSNITGLLLTRDGGKEISNTTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1167 - protein, 631 aa, Artificial Sequence
  Recombinant HIV protein
AENLWVTVYYGVPVWKEAETTLFCASDAKAYDTEKHNVWATHACVPTDPNPQEIVLKNVTENFNMWKNNMVEQMHEDIISLWDQSLKPCVKLTPLCVTLNCTNVFGNTTNNSDMRGMMKKCSFNITTEIRDKKQKEYALFYKTDVVPIDNDNTEYRMISCNTSVCTQACPKISFEPIPIHFCAPAGFAILKCFNKTFNGTGPCTNVSTVQCTHGIKPVVSTQLLLNGSLAEEEVVIRSENLTDNAKIIIVQLNKSVQINCTRPNNNTRKSIRIGPGRAFYATGGVIGDIRQAHCNISRADWYEALQQIAIKLREHFENRTIRFANSSGGDLEITTHSFNCAGEFFYCNTTQLFNSTWNGTGWSDNSENTTSNGTITLPCRIKQIVNLWQEVGQCMYAPPIRGVIRCVSNITGLLLTRDGGNNTTTNGTQTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1168 - protein, 656 aa, Artificial Sequence
  Recombinant HIV protein
AENLWVTVYYGVPVWKDAETTLFCASDAKGYEREAHNIWATHACVPTDPNPQELHLENVTEDFNMWKNTMVEQMHEDIISLWDQSLKPCVKITPLCVTLNCINVSFNSSNSSLNNSSNSSLNNSSLNSSSNDMRGQMKNCSFNVTTELRDKKKKEYALFYRQDIVQINENKNNSNQSKENNSSNSEYMLINCNTSTCAQACPKVSFEPIPIHYCAPAGFAILKCNDKGFSGTGKCKNVSTVQCTHGIKPVVTTQLLLNGSTAEGNVTIRSENITNNAKTIIVQLVKPVQINCTRPGNNTRKSVRIGPGQALYATGNIVGDIRQAHCNVSGAEWNETLSQVVTQLRKHFNNTIIRFANSSGGDLEITTHSFNCGGEFFYCDTSSLFNSTWENNTNSNWSNSTITLQCRIKQFINMWQRVGQCMYAPPIPGVIRCVSNITGILLTRDGGVNNDTNTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1169 - protein, 628 aa, Artificial Sequence
  Recombinant HIV protein
AENLWVTVYYGVPVWKDAETTLFCASDAKAYDKEVHNVWATHACVPTDPNPQEIKLTNVTENFNMWKNHMVEQMHTDIISLWDQSLKPCVKLTPLCVTLNCTNVTTNGDMRGGAKNCSFNMTTELRDKKKKVYSLFYKLDIVKIRENNNSDNYEYRLINCNTSTCTQACPKVTFEPIPIHYCAPAGFAILKCTDKKFNGTGPCSNVSSVQCTHGIKPVVSTQLLLNGSLAEEGIIIRSEDITNNAKTIIVQLTKPVQITCVRPNNNTRRGIRIGPGQAFYARDSIIGDIRQAYCNVSKAEWNETLQQVAKKLRDHYGNKTIRFANSSGGDLEITTHSFNCGGEFFYCNTSSLFNSTWNWNGTSIQGPNDTQSNGTITLPCRIKQIVNMWQRAGQCMYAPPIPGVIRCVSNITGLLLVRDGGNNSGSNETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1170 - protein, 631 aa, Artificial Sequence
  Recombinant HIV protein
AENLWVTVYYGVPVWKEAETTLFCASDAKAYKAEAHNIWATHACVPTDPNPREIQLENVTENFNMWKNNMVEQMHEDVISLWDQSLKPCVKLTPLCVTLNCINVKNENETKGNKTVDPDMRGGMKNCSFNVTTEVRDKKKQVYALFYKLDVVQMNDNNTNTEYRLINCNTSACTQECPKVTFEPIPIHYCAPAGFAILKCNNKMFNGTGPCNNVSTVQCTHGIKPVVSTQLLLNGSLAEEEIIIRSENITNNAKIIIVHLNESVQINCTRPYNNIRQRTRIGLGQALYTTRRIEDIRRAHCNISEAAWKETLEQVAKKLKVHFNRTTIRFANSSGGDLEITTHSFNCGGEFFYCNTSKLFNSSVGENNTLSISNGSNTNITLPCKIKQIVNMWQGVGQCMYAPPIQGVIRCVSNITGLLLTRDGGNTSQNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1171 - protein, 609 aa, Artificial Sequence
  Recombinant HIV protein
AENLWVTVYYGVPVWKEAEATLFCASDAKAQETEVHNIWATHACVPTDPNPQEMILENVTENFNMWKNDMVDQMHEDVISLWDQSLKPCIKLTPLCVTLNCTNVTYNGDMRGDVRNCSFNATTEVKNKKQEVNALFNLLDIVPIKNSEYRLTNCNTSACTQACPKVTFEPIPIHYCAPAGFAILKCNNKTFNGKGPCNNVSTVQCTHGIKPVVSTQLLLNGSLAEEDIIIRSENLTNNAKTIIVHLKEPVQIVCTRPGNNTRKSVRIGPGQAFYATGAIIGDIRKAHCNISKAAWNETLHKVEGKLREHYNKSIRFANSSGGDLEITTHSFNCRGEFFYCNTTKLFHSGSRKNSNDTITLPCRIKQFINMWQEVGQCMYAPPIAGVIRCVSSITGILLVRDGGTNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1172 - protein, 640 aa, Artificial Sequence
  Recombinant HIV protein
AENLWVTVYYGVPVWKEAETTLFCASDAKAYETEAHNIWATHACVPTDPNPQEIHIENVTENFNMWKNNMVEQMHEDIISLWDQSLQPCVKLTPLCVTLQCTNVTNSNKGNATNTTVASEAGMNTTVDMRGEMKNCSFNMTTELRDKKKKVYALFYRLDVVQINGNNKEYRLIHCNTSACTRACPKITFEPIPIHYCAPAGFAILRCNNKKFNGTGPCPNVSTVQCTHGIKPVVSTQLLLNGSLAEEEVMIRSENITDNAKTIIVQLNESVQINCTRPNNNTRKGVRIGPGQAFFANDVIGNIRQAHCNVSKATWNETLGKVVKKLRKHYNKNKIRFANSSGGDLEVTTHSFNCGGEFFYCSTSGLFNSTIDLNNTYNASIESNDSITLPCRIKQIINMWQRVGQCIYAPPIQGVIRCVSNITGILLTRDGGSTNSSSTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1173 - protein, 630 aa, Artificial Sequence
  Recombinant HIV protein
AENLWVTVYYGVPVWKEAEPTLFCASDAKAYETEVHNVWATYACVPTDPNPQEIHMENVTENFNMWKNNMVEQMHQDIISLWDEGLKPCVKLTPLCVTLQCTNVTTSNSNVTSNSTDASKVNKDMRGEMKNCSFNMTTELRDKKKKVYALFYRLDVVPINADNSNKEYRLINCNTSTCTQACPKVSFEPIPLHYCAPAGFAILKCNDKKFNGTGPCPNVSTVQCTHGIKPVVSTQLLLNGSIAEEEVMIRSENITNNAKIIIVQLNEPVQINCTRPNNNTRKSIRIGPGQAFYATGDIIGDIRQAHCNVSKATWNETLGKVVKRLRKHFPNNTIRFANSSGGDLEVTTHSFNCGGEFFYCNTSGLFNSTGLSSNDSLTIPCRIKQIINMWQRVGQCMYAPPIQGVIRCVSNITGLLLTRDGGSTNTNNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1174 - protein, 635 aa, Artificial Sequence
  Recombinant HIV protein
AENLWVTVYYGVPVWKDAETTLFCASDAKAHETEKHNVWATHACVPTDPNPQEIHLENVTENFNMWKNNMVEQMHTDIISLWDQSLKPCVQLTPLCVTLQCTNVTTTNNNTNITSDMRGEIRNCSFNMTTELRDKKQKVYSLFYRLDVVQINEGNNSSNNSNKEYRLINCNTSACTQACPKVSFEPIPIHYCAPAGFAILKCRDKKFNGTGVCPNVSTVQCTHGIKPVVSTQLLLNGSLAEEEVMIRTENITDNAKTIIVQLNKTVQINCTRPGNNTRKSIRIGPGQAFYATGDIIGGIRQAHCNVSKATWNETLGKVVKQLRKHFNKNIRFANPSGGDLEVTTHSFNCGGEFFYCNTSGLFNSTWKFNGTWNSTDLESSNDSITLPCRIKQIINMWQRVGQCMYAPPIQGVIRCVSSITGLLLTRDGGSTNSTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1175 - protein, 645 aa, Artificial Sequence
  Recombinant HIV protein
AENLWVTVYYGVPVWKEAETTLFCASDAKAYETEMHNVWATHACVPTDPNPQEIHLENVTENFNMWENNMVEQMHEDIISLWDQSLKPCVKLTPLCVTLQCTNVTITDITTVDKDMRGEIQNCSFNMTTELRDRKKKVYALFYRLDVVPINKRNSSTNNNSNNESNKEYRLINCNTSACTQACPKVSFEPIPIHYCAPAGFAILKCNSKKFNGTGPCPNVSTVQCTHGIKPVVSTQLLLNGSLAEEEVMVRSENITNNAKTIIVQLNESVQINCTRPNNNTRKSIRIGPGQAFYANGDIIGDIRQAHCNVSKATWNETLGKVVKKLRKHFNKNEIRFANSSGGDLEVTTHSFNCGGEFFYCNTTGLFNDSTWQHNNSEWEETSKRMNSSNDSITLQCRIKQIINMWQRVGQCMYAPPIQGVIRCVSNITGLLLTRDGGSTTSNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1176 - protein, 649 aa, Artificial Sequence
  Recombinant HIV protein
AENLWVTVYYGVPVWKEAETTLFCASDAKAYETEAHNIWATHACVPTDPNPQEIHLENVTENFNMWKNNMVEQMHEDIISLWEQSLKPCVKLTPLCVTLQCTNVTATNATATSQNSTDGSNKTVDMRGEMKNCSFNMTTELRDKKRKVYALFYRLDVVQINDKNTNGTNKEYRLINCNTSACTQACPKITFEPIPIHYCAPAGFAILKCNNKKFNGTGPCPNVSTVQCTHGIKPVVSTQLLLNGSLAEEEVMIRSENITNNAKIIIVQLNEAVQINCTRPSNNTRKSVRIGPGQAFYATGDIIGDIRQAHCNVSKATWNETLGKVVKKLRKHFNTNKIRFANSSGGDLEVTTHSFNCGGEFFYCNTAGLFNSTWNRTNSEWINSKWTNKTSNDSITLQCRIKQIINMWQRVGQCMYAPPVQGVIRCVSNITGLLLTRDGGSTDNNRQTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1177 - protein, 635 aa, Artificial Sequence
  Recombinant HIV protein
AENLWVTVYYGVPVWKEAETTLFCASEAKAYETEVHNVWATHACVPTDPNPQEIHLENVTENFNMWKNNMVEQMHEDIISLWDQSLKPCVRLTPLCVTLQCTNVTNTTNTNNTTNTNSSKDMRGEMKNCSFNMTTELRDKKQKVYALLYRTDVVSINNTNKEYRLISCNTSVCTQACPKVTFEPIPIHYCAPAGFAILKCNEDKFNGTGPCPNVSTVQCTHGIKPTVSTQLLLNGSLAKEEVMIRSENISDNAKIIIVQLNDPVQINCTRPNNNTRKSIRLGPGQAFYATGDIIGDIRQAHCNVSKATWNETLGKVVKKLRKHFNNNTIRFANSSGGDLEVTMHSFNCGGEFFYCDTSGLFNSTWNSNSTWNDTNNNNSNDSITLSCRIRQIINMWQRVGQCMYAPPIQGVIRCVSNITGLLLARDGGSTTNVTETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1178 - protein, 634 aa, Artificial Sequence
  Recombinant HIV protein
AENLWVTVYYGVPVWKEAETTLFCASDAKAYETEVHNVWATHACVPTDPNPQEIHLENVTENFNMWKNNMVEQMHEDIISLWDESLKPCVKLTPLCVTLQCTNVTITKNTTNPTSSSWGMDMRGEIKNCSFNMTTELRDKKKKVYALFYRLDVVPINNTNNKEYRLISCNTSVCTQACPKVSFEPIPIHYCVPAGFAMLKCNNKKFNGTGPCPNVSTVQCTHGIKPVVSTQLLLNGSLAEEEVMIRSENITDNAKTIIVQLNESVQINCTRPNNNTRKRLRIGPGQAFYARRDIIGDIRQAHCNVSKATWNETLGKVVKKLRKHFRNNTIRFANSSGGDLEVTMHSFNCGGEFFYCNTAGLFNSTWNVTGGTNGTESNDSITLQCRIKQIINMWQRVGQCMYAPPIQGVIRCVSNITGLLLTRDGGSTTETETEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1179 - protein, 622 aa, Artificial Sequence
  Recombinant HIV protein
AENLWVTVYYGVPVWKEAETTLFCASDAKAYETEAHNIWATHACVPTDPNPREIHIENVTENFNMWKNNMVEQMHEDIISLWDQSLKPCVKLTPLCVTLQCTNVTKNNTINDMRGEMKNCSFNMTTELRDRKKKVYALFYRLDVVPINDNNSTNKEYRLINCNTSACTQACPKVTFEPIPIHYCAPAGFAILKCNNKKFNGTGPCPNVSTVQCTHGIKPVVSTQLLLNGSLAEEEVMIRSENITNNAKIIIVQLNESVQINCTRPYNNTRKGVRIGPGQAFYATDIIGDIRQAHCNVSKATWNETLGKVVKKLRKHFKKNTIRFANSSGGDLEVTTHSFNCGGEFFYCNTTGLFNSTWGNNSTGSNDSITLPCRIKQIINMWQRVGQCMYAPPIQGVIRCVSNITGLLLTRDGGSTESSQTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1180 - protein, 634 aa, Artificial Sequence
  Recombinant HIV protein
AENLWVTVYYGVPVWKEAETTLFCASDAKAYETEVHNVWATHACVPTDPNPQEIHLENVTENFNMWKNNMVEQMHEDIISLWDQSLKPCVKLTPLCVTLQCTNVTNATSRNVTNTTSSSRGMDMRGEMKNCSFNMTTELRDKKQKVYALFYRLDVVPINNKNKEYRLISCNTSVCTQACPKVSFEPIPIHYCAPAGFAILKCKDKKFNGTGPCPNVSTVQCTHGIKPVVSTQLLLNGSLAEEEVMIRSENITNNAKTIIVQLNESVQINCTRPNNNTRKSIRIGPGQAFYATGDIIGDIRQAHCNVSKATWNETLGKVVKKLRKHFGNNTIRFANSSGGDLEVTTHSFNCGGEFFYCNTTGLFNSTWNVTEESNNTVSNDSITLPCRIKQIINMWQRVGQCMYAPPIQGVIRCVSNITGLLLTRDGGSTDNKTEVFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1181 - protein, 634 aa, Artificial Sequence
  Recombinant HIV protein
AENLWVTVYYGVPVWKEAETTLFCASDAKAYETEVHNVWATHACVPTDPNPQEIHMENVTENFNMWKNNVVEQMHEDIISLWDQSLKPCVKLTPLCVTLQCTNVTNATNGNNTNTTSSSGGMDMRGEMKNCSFNMTTELRDKKQKVYALFYRLDVVPINNKNKEYRLISCNTSVCTQACPKVSFEPIPIHYCAPAGFAILKCKDKKFNGTGPCPNVSTVQCTHGIKPVVSTQLLLNGSLAEEEVMIRSENITNNAKIIVVQLNESVQINCTRPNNNTRKSIRIGPGQAFYATGDIIGDIRQAHCNVSKATWNETLGKVVKKLRKHFGNNTIRFANSSGGDLEVTTHSFNCGGEFFYCNTTGLFNSTWNVTEESNNTVSNDSITLPCRIKQIINMWQRVGQCMYAPPIQGVIRCVSNITGLLLTRDGGSTDDKTEVFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1182 - protein, 651 aa, Artificial Sequence
  Recombinant HIV protein
AENLWVTVYYGVPVWKEAETTLFCASDAKAYETEVHNVWATHACVPTDPNPQEIHLENVTEDFNVWKNNMVEQMHEDIISLWDQSLKPCVKLTPLCVTLQCTNVTTTCITTNNSTMTNSSNSSTEGNCSSYNYDMRGELRNCSFNMTTELRDKKQKVYALFYRLDVVPINSDNSDNKEYRLINCNTSVCTQACPKISFEPIPIHYCAPAGFAILKCNDKKFNGTGTCPNVSTVQCTHGIKPVVSTQLLLNGSLAEEEVMLRSENITNNAKTIIVQLNDPVQINCTRPNNNTIKSIRLGPGQAFHATGDIIGDIRQAHCNVSKATWNETLGKVVKKLRKHFENNTIRFANSTGGDLEVTMHSFNCGGEFFYCNTTGLFNSTWYNTTNSSWNNKTWSNDSITLPCRIKQIINMWQRVGQCIYAPPIQGVIRCVSNITGLLLTRDGGSTNNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1183 - protein, 631 aa, Artificial Sequence
  Recombinant HIV protein
AENLWVTVYYGVPVWKEAETALFCASDAKAYETEVHNVWATHACVPTDPDPQEIHLENVTENFNMYKNNMVEQMHEDIINLWDQSLKPCVKLTPLCVTLQCTNVTNATIENVTNPNMKDMRGEIKNCSFNMTKELRDKKQKVYALFYRLDVVPINDNKEYILISCNTSTCTQACPKVSFEPIPIHYCAPAGFAILKCKDKKFNGTGPCPNVSTVQCTHGIKPVVSTQLLLNGSLAEEEVMIRCENITNNAKTIIVQLNESVQINCTRPNNNTRKGIRMGPGQAFLAREDIIGNIRQAHCNVSKATWNETLGKVVKKLRKHFRNNTIRFANSSGGDLEVTLHSFNCGGEFFYCNTTGLFNSTWNITRNDNEGSNSSNDSITLPCRIKQIINMWQRVGQCMYAPPIQGVIRCVSNITGLLLTRDGGSTSSETEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1184 - protein, 625 aa, Artificial Sequence
  Recombinant HIV protein
AENLWVTVYYGVPVWKEAETTLFCASDARAYETEVHNIWATHACVPTDPNPQEIHLENVTENFNMWINNMVEQMHEDIISLWDQSLKPCVKLTPLCVTLQCTNVTTTNTSSTDMRGEIKNCSFNMTTELRDKKKVYALFYRLDVVPINNDNKEYILINCNTSVCTQACPKVSFEPIPIHYCTPAGFAILKCNNKKFNGTGPCPNVSTVQCTHGIKPVVSTQLLLNGSLAEEEVMIRSENISNNAKVIIVQLNKSVQINCTRPNNNTRKSIRLGPGQAFYATGDIIGNIRQAHCNVSKATWNETLGKVVKKLRKHYGNNTIRFANSSGGDLEVTMHSFNCGGEFFYCNTSGLFNSTWNVTGTVNGTTSNDSITLPCSIKQIINMWQRVGQCIYAPPIQGVIRCVSNITGLLLTRDGGSTSTTTETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1185 - protein, 653 aa, Artificial Sequence
  Recombinant HIV protein
AENLWVTVYYGVPVWKDAETTLFCASDAKAYETEVHNVWATHACVPTDPNPQEIHMENVTEDFNMWKNNMVEQMHEDVISLWDQSLKPCVKLTPLCVTLQCTNVTVSSNGTVASNKDMRGEMRNCSFNMTTELRDKKKKVYALFYRLDVVPINDENSNKNCSKNSGQNCNKEYRLINCNTSACTQACPKVSFEPIPIHYCTPAGFALLKCNNKKFNGTGPCPNVSTVQCTHGIKPVVSTQLLLNGSLAEEEVMIRSENITNNAKTIIVQLNQSVQINCTRPNNNTRKSIRIGPGQAFFAHGDIIGDIRQAHCNVSKATWNETLGKVVKKLRKHFPNNTIRFANSSGGDLEVTTHSFNCGGEFFYCNTSGLFNSTYMSNGTFRFNGTVFNGTGGDSNDSITIPCRIKQIINMWQRVGQCMYAPPIQGVIRCVSNITGLLLVRDGGSTNNTNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1186 - protein, 645 aa, Artificial Sequence
  Recombinant HIV protein
AENLWVTVYYGVPVWKEAETTLFCASDAKAYETEVHNIWATHACVPTDPNPQEIHLENVTENFNMWKNNMVEQMQEDIISLWDQSLQPCVKLTPLCVNLQCTNVTATNATATNSTVAPAPNSTAARTDMRGEMKNCSFNMTTELRDKKKVYALFYRLDVVPINKGNDNKEYRLLKCNTSVCTQACPKVSFEPIPLHYCAPAGFAILKCNNKKFNGTGPCPNVSTVQCTHGIKPVVSTQLLLNGSLAEEEVMIRSENISNNAKTIIVQLNEPVQINCTRPNNNTRKSMRLGPGQAFYATGDIIGDIRQAHCNVSKATWNETLGKVVKKLRKHFGNNTVRFANSSGGDLEVTMHSFNCGGEFFYCNTAGLFNSTWNTTKIWGNTTEGSNDSITLPCKIKQIINMWQRVGQCIYAPPIQGVIRCVSNITGLLLTRDGGSTGNGSNETETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1187 - protein, 629 aa, Artificial Sequence
  Recombinant HIV protein
AENLWVTVYYGVPVWKETETTLFCASDAKAYETEVHNVWATHACVPTDPNPQEIHLENVTEDFNMWKNNMVEQMQEDVINLWDQSLKPCVKLTPLCVTLQCTNVTATNTTSSSEGMDMRGEIKNCSFNMTKELRDKKQKVYALFYRLDVVPINNKNNKEYRLISCNTSVCTQACPKVSFEPIPIHYCAPAGFAILKCNNKKFNGTGQCPNVSTVQCTHGIKPVVSTQLLLNGSLAEEEVMIRSENITDNAKTIIVQLNESVQINCTRPSNNTRKSIRIGPGQAFYATGDIIGDIRQAHCNVSKATWNETLGKVVKKLRKHFNNNTIRFANSSGGDLEVTMHSFNCGGEFFYCNTTGLFNSTWNDTEKSSGTESNDSITLPCRIKQIINMWQRVGQCMYAPPIQGVIRCVSNITGLLLTRDGGSTESETEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1188 - protein, 628 aa, Artificial Sequence
  Recombinant HIV protein
AENLWVTVYYGVPVWKEAETTLFCASDAKAYETEVHNVWATHACVPTDPNPQEIHLENVTEHFNMWKNNMVEQMQEDIISLWDQSLKPCVKLTPLCVTLQCTNVTATNTTNDSEGTDMRGEIKNCSFNMTTELRDEKQKVYALFYRLDVVPINNNNKEYRLISCDTSVCTQACPKISFEPIPIHYCAPAGFAILKCNDKKFNGTGPCPNVSTVQCTHGIKPVVSTQLLLNGSLAEEEVMIRSENITNNAKTIIVQLNESVQINCTRPNNNTRKSIRIGPGQAFYATGDIIGDIRQAHCNVSKATWNETLGKVVKKLRKHFENNTIRFANSSGGDLEVTMHSFNCGGEFFYCNTTGLFNSTWNNNTEGSNNTSNDSITLPCRIKQIINMWQRVGQCMYAPPIQGVIRCVSNITGLLLTRDGGSTENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1189 - protein, 640 aa, Artificial Sequence
  Recombinant HIV protein
AENLWVTVYYGVPVWKDAETTLFCASDAKAYETEKHNVWATHACVPTDPNPQEIHLENVTEKFNMWKNNMVEQMHTDIISLWDQSLKPCVKLTPLCVTLQCTNVTVTSENSTIMDMRGEIKNCSFNMTTELRDKKQKVYSLFYRLDVVQINENQGNSSNNNNKEYRLINCNTSACTQACPKVSFEPIPIHYCAPAGFAILKCKDEKFNGTGPCPNVSTVQCTHGIKPVVSTQLLLNGSTAEEEVMIRSENITNNAKIIIVQLNKPVQINCTRPNNNTRKSVRIGPGQAFYATGDIIGNIRQAHCNVSKATWNETLGKVVKQLRKHFENNTIRFANSSGGDLEVTTHSFNCGGEFFYCNTSGLFNSTWSHNNSTLLGSNSTESNDSITLPCRIKQIINMWQRTGQCMYAPPIQGVIRCVSNITGLILTRDGGSTNSTNETETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1190 - protein, 639 aa, Artificial Sequence
  Recombinant HIV protein
AENLWVTVYYGVPVWKEAETTLFCASDAKAYETEVHNVWATHACVPTDPNPQEIHLENVTENFNMWKNNMVEQMHEDIISLWDQSLKPCVKLTPLCVTLQCTNVTNTTNTNNNTDNNNSKSEGTDMRGEMKNCSFNMTTELRDKKQKVYALLYRLDVVSINNDNKEYRLISCNTSVCTQACPKISFEPIPIHYCAPAGFAILKCNDKKFNGTGSCPNVSTVQCTHGIKPVVSTQLLLNGSLAEEEVMIRSENITDNAKTIIVQLNESVQINCTRPNYNKRKRIRIGPGQAFYATKDIKGTIRQAHCNVSKATWNETLGKVVKKLRKHFKNNTIRFANSSGGDLEVTMHSFNCGGEFFYCNTSGLFNSTWNSNNTWNNTTGSNDSITLQCKIKQIINMWQRVGQCMYAPPIQGVIRCVSNITGLLLTRDGGSTTDTNDTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1191 - protein, 647 aa, Artificial Sequence
  Recombinant HIV protein
AENLWVTVYYGVPVWKEAETTLFCASDAKAYETEAHNIWATHACVPTDPNPREIHLENVTEHFNMWKNNMVEQMHKDIISLWDQSLKPCVKLTPLCVTLQCTNVTNETIAKTFNKNKTMKNETMKNLNDTIKDMRGEMTNCSFNMTTELRDKKKKVYALFYRLDVVKINGGNKEYRLINCNTSVCTQACPKITFEPIPIHYCAPAGFAILKCNNKKFNGTGPCPNVSTVQCTHGIKPVVSTQLLLNGSLAEEEVMIRSENITNNAKTIIVQLNESVQINCTRPSNNTRKSIRIGPGQAFYATDVIGNIRQAHCNVSKATWNETLGKVVKKLRKHFSNNTIRFANSSGGDLEVTTHSFNCGGEFFYCNTSGLFNSTWDNDTWSDTTNSTGGSNDSITLPCRIKQIINMWQRVGQCMYAPPIQGVIRCVSNVTGLLLTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1192 - protein, 646 aa, Artificial Sequence
  Recombinant HIV protein
AENLWVTVYYGVPVWKEAETTLFCASDAKAYETEVHNVWATHACVPTDPNPQEIHLENVTENFNMWKNNMVEQMHEDIISLWDQSLKPCVKLTPLCVTLQCTNVTNATNTTNPTVSSRVIKKDMRGEVKNCSFNMTTELRDRKQKVYALFYRPDVVPINDHTIENNNTIENNKEYRLISCNTSVCTQACPKISFEPIPIHYCTPAGFAILKCNDKKFNGTGPCPNVSTVQCTHGIKPVVSTQLLLNGSRAEEEVMIRSENITNNAKTIIVQLNKTVQINCTRPNNNTRKSIRIGPGQAFYATGDIIGDIRQAHCNVSKATWNETLGKVVKKLRKHFGNNTIRFANSSGGDLEVTTHSFNCGGEFFYCNTTGLFNSTWDANGNCTGCDESDSNDSITLPCRIKQIINMWQRVGQCMYAPPIQGVIRCVSNITGLLLTRDGGSTNTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1193 - protein, 622 aa, Artificial Sequence
  Recombinant HIV protein
AENLWVTVYYGVPVWKDAETTLFCASNAKAYETEVNIWATHACVPTDPNPQEIHLENVTEEFNMWKNNMVEQMHTDIISLWDQGLKPCVKLTPLCVTLQCTNVTKSDKITKDMRGEIKNCSFNMTTELRDKKQKVYSLFYRLDVVPINGKNNKEYRLINCNTSACTQACPKVTFEPIPIHYCAPAGFAILKCNDKKFNGTGPCPNVSSVQCTHGIKPVVSTQLLLNGSLAEEEVMIRSEDITNNAKNIIVQLNTPVQINCTRPNNNTRKSVRIGPGQAFYATDDIIGNIRQAHCNVSKATWNETLGKVVKQLRKHFNKTIRFANSAGGDLEVTTHSFNCGGEFFYCDTSGLFNSTWTWNDTVSWQSNDSITLQCRIKQIINMWQRAGQCIYAPPIQGVIRCVSNITGLILTRDGGSTSSPTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1194 - protein, 648 aa, Artificial Sequence
  Recombinant HIV protein
AENLWVTVYYGVPVWKEAETTLFCASDAKAYETEKHNVWATHACVPTDPNPQEIHLENVTENFNMWKNNMVEQMHEDIISLWDESLKPCVKLTPLCVTLQCTNVTKTSYANKTSNETYKTSNDMRGEIKNCSFNMPTELRDKKQKVYALFYRLDVIPINDNNNSSKNNNGSNKEYRLINCNTSVCTQACPKVSFEPIPIHYCAPAGFAILKCNNKKFNGTGPCPNVSTVQCTHGIKPVVSTQLLLNGSLAEEEVMIRSENITNNAKTIIVQLNKSVQINCTRPGNNTRKSIRIGPGQAFYATGDIIGDIRQAHCNVSKATWNETLGKVVKKLRKHFGTNNTIRFANSSGGDLEVTMHSFNCGGEFFYCNTTGLFNSTWEFHGNWTRSNFTESSNDSITLPCRIKQIINMWQRVGQCMYAPPIQGVIRCVSNITGLLLTRDGGSTGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1195 - protein, 628 aa, Artificial Sequence
  Recombinant HIV protein
AENLWVTVYYGVPVWKEAETTLFCASDAKAYETEVHNVWATHACVPTDPNPQEIHLENVTENFNMWKNNMVEQMHEDIISLWDQSLKPCVKLTPLCVTLQCTNVTNATNTKSSNWKEDMRGEIKNCSFNMTTELRDKKQKVYALFYRLDVVPINNDNKEYKLINCNTSVCTQACPKVSFEPIPIHYCAPAGFAILKCNDKKFNGTGPCPNVSTVQCTHGIKPVVSTQLLLNGSLAEEEVMIRSENITDNAKTIIVQLNESVQINCTRPNNNTRKSIRIGPGQAFYATGDIIGDIRQAHCNVSKATWNETLGKVVKKLRKHFGNNTIRFANSSGGDLEVTMHSFNCGGEFFYCNTTGLFNSTWNNTIGPNNSNDSITLPCRIKQIINMWQRVGQCMYAPPIQGVIRCVSNITGLLLTRDGGSTISNTTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1196 - protein, 631 aa, Artificial Sequence
  Recombinant HIV protein
AENLWVTVYYGVPVWKEAETTLFCASDAKAYETEKHNVWATHACVPTDPNPQEIHLENVTENFNMWKNNMVEQMHEDIISLWDQSLKPCVKLTPLCVTLQCTNVTGNTTNNSDMRGEMKKCSFNMTTELRDKKQKVYALFYRTDVVPINNDNKEYRMISCNTSVCTQACPKISFEPIPIHFCAPAGFAILKCFNKKFNGTGPCPNVSTVQCTHGIKPVVSTQLLLNGSLAEEEVMIRSENITDNAKIIIVQLNKSVQINCTRPNNNTRKSIRIGPGQAFYATGDVIGDIRQAHCNVSKATWNEALGKVVKKLRKHFENNTIRFANSSGGDLEVTTHSFNCGGEFFYCNTTGLFNSTWNGTGWSDNSENTTSNDSITLPCRIKQIINMWQRVGQCMYAPPIQGVIRCVSNITGLLLTRDGGSTTTTNGTQTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1197 - protein, 656 aa, Artificial Sequence
  Recombinant HIV protein
AENLWVTVYYGVPVWKDAETTLFCASDAKAYETEAHNIWATHACVPTDPNPQEIHLENVTEDFNMWKNNMVEQMHEDIISLWDQSLKPCVKITPLCVTLQCTNVTFNSSNSSLNNSSNSSLNNSSLNSSSNDMRGEMKNCSFNMTTELRDKKKKVYALFYRQDVVQINENKNNSNQSKENNSSNKEYMLINCNTSTCTQACPKVSFEPIPIHYCAPAGFAILKCNDKKFNGTGKCPNVSTVQCTHGIKPVVTTQLLLNGSTAEEEVMIRSENITNNAKTIIVQLNKPVQINCTRPGNNTRKSVRIGPGQAFYATGDIVGDIRQAHCNVSKATWNETLGKVVKQLRKHFNNNIIRFANSSGGDLEVTTHSFNCGGEFFYCDTSGLFNSTWENNTNSNWSNDSITLQCRIKQFINMWQRVGQCMYAPPIQGVIRCVSNITGILLTRDGGSTNDTNTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1198 - protein, 628 aa, Artificial Sequence
  Recombinant HIV protein
AENLWVTVYYGVPVWKDAETTLFCASDAKAYETEVHNVWATHACVPTDPNPQEIHLENVTENFNMWKNNMVEQMHTDIISLWDQSLKPCVKLTPLCVTLQCTNVTTNGDMRGEAKNCSFNMTTELRDKKKKVYSLFYRLDVVKINENNNSDNKEYRLINCNTSTCTQACPKVTFEPIPIHYCAPAGFAILKCTDKKFNGTGPCPNVSSVQCTHGIKPVVSTQLLLNGSLAEEEVMIRSEDITNNAKTIIVQLNKPVQINCTRPNNNTRKGIRIGPGQAFYARDDIIGDIRQAHCNVSKATWNETLGKVVKKLRKHYGNNTIRFANSSGGDLEVTTHSFNCGGEFFYCNTSGLFNSTWNWNGTSIQGPNDTQSNDSITLPCRIKQIINMWQRAGQCMYAPPIQGVIRCVSNITGLLLVRDGGSTSGSTETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1199 - protein, 632 aa, Artificial Sequence
  Recombinant HIV protein
AENLWVTVYYGVPVWKEAETTLFCASDAKAYETEAHNIWATHACVPTDPNPREIHLENVTENFNMWKNNMVEQMHEDVISLWDQSLKPCVKLTPLCVTLQCTNVTNENETKGNKTVDPDMRGEMKNCSFNMTTELRDKKKKVYALFYRLDVVQINDNNTNKEYRLINCNTSACTQECPKVTFEPIPIHYCAPAGFAILKCNNKKFNGTGPCPNVSTVQCTHGIKPVVSTQLLLNGSLAEEEVMIRSENITNNAKIIIVQLNESVQINCTRPYNNIRKRTRIGLGQAFYATDRIEDIRQAHCNVSKATWNETLGKVVKKLRKHFNRNTIRFANSSGGDLEVTTHSFNCGGEFFYCNTSGLFNSTVGENNTLSISNGSNDSITLPCKIKQIINMWQRVGQCMYAPPIQGVIRCVSNITGLLLTRDGGSTTSQTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1200 - protein, 609 aa, Artificial Sequence
  Recombinant HIV protein
AENLWVTVYYGVPVWKEAEATLFCASDAKAQETEVHNIWATHACVPTDPNPQEIHLENVTENFNMWKNNMVEQMHEDVISLWDQSLKPCIKLTPLCVTLQCTNVTYNGDMRGEVRNCSFNMTTELRDKKQKVYALFYRLDVVPINNKEYRLTNCNTSACTQACPKVTFEPIPIHYCAPAGFAILKCNNKKFNGTGPCPNVSTVQCTHGIKPVVSTQLLLNGSLAEEEVMIRSENITNNAKTIIVQLNEPVQINCTRPGNNTRKSVRIGPGQAFYATGDIIGDIRQAHCNVSKATWNETLGKVVKKLRKHYNNSIRFANSSGGDLEVTTHSFNCGGEFFYCNTTGLFHSTSRKNSNDSITLPCRIKQFINMWQRVGQCMYAPPIQGVIRCVSSITGILLVRDGGSTNTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1201 - protein, 790 aa, Artificial Sequence
  Recombinant HIV protein
AENLWVTVYYGVPVWKEAKTTLFCASDAKAYETEVHNIWATHACVPTDPNPQEMELPNVTENFNMWKNDMVDQMHEDIISLWDQSLKPCVKLTPLCVTLNCTITNSSSIMTNCTFNTTTELKDKKRKASASFYRLDIVPLNGDSNGSSSGSYRLINCNTSTCTQACPKVSFDPIPIHYCAPAGYAILKCNDETFNGTGPCHNVSTVQCTHGIKPVVSTQLLLNGSLSEGEIIIRSENLTDNVKTIIVHLNKSIEINCIRTGNNTRRSIRIGPGQTFYATGDIIGDIRKAYCNISKHIWNKTLEEVATKLGAHFINKTIKFAPPSGGDLEITTHSFNCRGEFFYCNTTQLFNNISIGRFNTSIENDTNIILPCRIKQIINMWQEVGRCMYAPPIEGNITCRSNITGILLTRDGGNGGADNSTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1202 - protein, 802 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1203 - protein, 787 aa, Artificial Sequence
  Recombinant HIV protein
AENLWVTVYYGVPVWKEANPTLFCASDAKAYKTEMHNVWATHACVPTDPNPQEMVLENVTEDFNMWKNGMVEQMHQDIISLWDQSLKPCVKLTPLCVTLNCTEVTRSSNGTINNNSTEMKNCSFNVTTDLRDKKKKEHALFYRLDIVPLDETNGTSSEYRLINCNTSTCTQACPKVSFDPIPIHYCAPAGYAILKCKDKKFNGTGPCKNVSTVQCTHGIKPVVSTQLLLNGSIAEGEIIIRSENLTNNAKIIIVQLNVTVEINCTRPNNNTRRSIRIGPGQTFYATGEIIGDIRQAHCNISREKWNRTLQKVEKKLEELFPNKTIHFTSSSGGDLEITTHSFNCMGEFFYCNTSALFNNNNDSTNSNITLPCRIRQFINMWQEVGRCMYAPPIQGVITCKSNVTGLLLTRDGGIINDTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1204 - protein, 802 aa, Artificial Sequence
  Recombinant HIV protein
AENLWVTVYYGVPVWRDADTTLFCASDAKVHSTEVHNVWATHACVPTDPNPQEIHLENVTENFNMWQNKMAEQMQEDVISLWDQSLKPCIKLTPLCVTLSCTEAKFNETFNKIDNITKVSNLTDEMRNCSFNMTTELRDKKQQVYALFYKLDIVPIDNSSEYRLINCNTSVCKQACPKVSFDPIPIHYCTPAGYAILKCNDKNFNGTGPCKNVSSVQCTHGIKPVVSTHLLLNGSLAEEEIVIRSEDITKNTKTIIVHLNKSVEINCTRPSNNTRTSVRIGPGQVFYRTGEVITSIRKAYCEINGTKWNETLRQVAKKLKEHFKNKTIIFQPPSGGDLEVTTHHFNCRGEFFYCDTAQLFNSTWRGNETKEERNGTSNDIIILPCRIKQIVRMWQGVGQCMYAPPISGIINCVSNITGILLTSDGDGGPTADNETFRPAGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1205 - protein, 797 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1206 - protein, 808 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1207 - protein, 816 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1208 - protein, 799 aa, Artificial Sequence
  Recombinant HIV protein
AENLWVTVYYGVPVWKDADTTLFCASDAKAHETEAHNIWATHACVPTDPNPQEIYMENVTENFNMWKNNMVEQMQEDIISLWDQSLKPCVKLTHLCVTLSCTNVTLTNVNYTNNFPNIGNITDEVRNCSFNVTTEIRDKKQKVYALFYKTDIVQMENKNSYRLINCNTSVCKQACPKISFDPIPIHYCTPAGYAILKCNEKNFNGTGPCKNVSSVQCTHGIKPVVSTQLLLNGSLAEGEIIIRSENLTNNAKTIIVHLNKSVEINCTRPSNNTRTSVTIGPGQVFYRTGDIIGDIRKAYCEINGTKWNETLKQVVGKLKEHFPNKKISFQPPSGGDLEITMHHFNCRGEFFYCNTTQLFNSTWINSTGIKEYNDTIIYLPCKIKQIINMWQGVGQCMYAPPIRGKINCVSNITGILLTRDGGDANATNDTETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1209 - protein, 795 aa, Artificial Sequence
  Recombinant HIV protein
AENLWVTVYYGVPVWRDADTTLFCASDAKAQETEAHNIWATHACVPTDPNPQEIHLENVTENFNMWKNNMVEQMQEDVISLWDQSLKPCVKLTPLCVTLNCTTAKVINATIPANVSNIMGNITDEVRNCSFNMTTELRDRKQKAYALFYKLDIVQIKDNKNSSSEYRLINCNTSVCKQACPKVSFDPIPIHYCTPAGYALLKCNDKNFNGTGPCNNVSSVQCTHGIKPVVSTQLLLNGSLAEEEIIISSENLTNNAKTIIVHLNKSVEINCTRPSVNTRTSMHIGPGQVLYRTGDIIGDIRNAYCEIDGTKWSEALELVTEKLKKHFSEIKFQPPSGGDLEITMHHFNCKGEFFYCNTSQLFNNNHKECNGTITLPCRIKQIINMWQGAGQCMYAPPISGKINCVSNITGILLTRDGGTNNNTNSSETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1210 - protein, 786 aa, Artificial Sequence
  Recombinant HIV protein
AENLWVTVYYGVPVWKEAKATLFCASDARAYEKEVHNVWATHACVPTDPNPQEIYLGNVTENFNMWKNDMVDQMHEDIISLWDQSLKPCVKLTPLCVTLRCTNATINGSLTEEVKNCSFNITTELRDKKQKAYALFYRPDVVPLNKNSPSGNSSEYILINCNTSTCTQACPKVSFDPIPIHYCAPAGYAILKCNNKTFNGTGPCNNVSTVQCTHGIKPVVSTQLLLNGSLAEEDIIIKSENLTNNIKTIIVHLNKSVEIVCRRPNNNTRKSIRIGPGQAFYATNDIIGDIRQAHCNINNSTWNRTLEQIKKKLREHFLNRTIEFEPPSGGDLEVTTHSFNCGGEFFYCNTTRLFKWSSNVTNDTITIPCRIKQFINMWQGAGRCMYAPPIEGNITCNSSITGLLLTRDGGKTDRNDTEIFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1211 - protein, 802 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1212 - protein, 804 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1213 - protein, 797 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1214 - protein, 795 aa, Artificial Sequence
  Recombinant HIV protein
AENLWVTVYYGVPVWKEAKTTLFCASEAKAYEKEVHNVWATHACVPTDPNPQEMVLENVTENFNMWKNDMVNQMHEDIISLWDQSLKPCVKLTPLCVTLNCTNANGTNNNGTVNVNDTMYGEIKNCSFNMTTELRDKKKQVYALFYKLDIVSLNENSNNSSEYRLINCNTSVCTQACPKVTFDPIPIHYCAPAGYAILKCNNKTFTGIGPCKNVSTVQCTHGIKPVVSTQLLLNGSLAEEEIIVRSENLTDNVKTIIVHLNESVEIVCTRPNNNTRKSVRIGPGQTFYATGAIIGDIRQAHCNISTIKWNKTLQGVEKKLKEHFPNKTIEFKPSSGGDLEITTHSFNCRGEFFCCNTSNLFTSNLFTDNLTNTTNITLPCRIKQIINMWQGVGRCMYAPPIAGNITCKSNITGLLLTRDGGENNRTETFRPGGGDMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1215 - protein, 802 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1216 - protein, 799 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1217 - protein, 798 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1218 - protein, 789 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDGGSGGDIIKLLNEQVNKEMQSSNLYMSMSSWCYTHSLDGAGLFLFDHAAEEYEHAKKLIIFLNENNVPVQLTSISAPEHKFEGLTQIFQKAYEHEQHISESINNIVDHAIKSKDHATFNFLQWYVAEQHEEEVLFKDILDKIELIGNENHGLYLADQYVKGIAKSRKS

SEQ ID NO: 1219 - protein, 874 aa, Human Immunodeficiency Virus
MRVMGIQRNCQHLLTWGIMILGTIIFCSAVENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSAITQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQAMYAPPIPGVISCVSNITGLLLTRDGGGNNNTNETFRPGGGDMRDNWRSELYKYKVVEIEPLGVAPTRAKRRVVEREKRAVGIGAVFLGFLGAAGSTMGATSITLTVQARQLLSGIVQQQNNLLRAIEAQQHLLKLTVWGIKQLQARVLAVERYLRDQQLLGIWGCSGKLICTTNVPWNSSWSNKSLDEIWNNMTWLQWDKEINNYTQLIYRLIEESQNQQEKNEKELLELDKWANLWSWFDISNWLWYIKIFIIIVGGLIGLRIVFAVLSVINRVRQGYSPLSFQTHTPNPRGLDRPERIEEEDGEQGRGRSIRLVSGFLALAWDDLRSLCLFSYHRLRDFILIAARTVELLGHSSLKGLRLGWEGIKYLWNLLSYWGRELKISAINLVDTIAIAVAGWTDRVIEIAQRIGRAILHIPVRIRQGLERALL

SEQ ID NO: 1220 - protein, 855 aa, Human Immunodeficiency Virus
MRVMGIQRNCQHLLTWGIMILGTIIFCSAVENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSAITQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQAIYAPPIQGEIRCVSNITGLLLTRDGGNNNGTSETFRPEGGNMRDNWRSELYKYKVVEIEPLGVAPTRAKRRVVEREKRAVGIGAVFLGFLGAAGSTMGATSITLTVQARQLLSGIVQQQNNLLRAIEAQQHLLKLTVWGIKQLQARVLAVERYLRDQQLLGIWGCSGKLICTTNVPWNSSWSNKSLDEIWNNMTWLQWDKEINNYTQLIYRLIEESQNQQEKNEKELLELDKWANLWSWFDISNWLWYIKIFIIIVGGLIGLRIVFAVLSVINRVRQGYSPLSFQTHTPNPRGLDRPERIEEEDGEQGRGRSIRLVSGFLALAWDDLRSLCLFSYHRLRDFILIAARTVELLGHSSLKGLRLGWEGIKYLWNLLSYWGRELKISAINLVDTIAIAVAGWTDRVIEIAQRIGRAILHIPVRIRQGLERALL

SEQ ID NO: 1221 - protein, 859 aa, Human Immunodeficiency Virus
MRVMETQRNYQHLLSWGIMILGMLIICSATNLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSAITQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRAIYAPPIPGVVKCKSNITGLILTRDGGDDENNTETFRPGGGNMRDNWRSELYKYKVVKIEPLGVAPTKARRRTVEREKRAVGIGAVFLGFLGAAGSTMGAASITLTVQARQLLAGIVQQQSNLLRAIEAQQQMLRLTVWGIKQLQARVLAVERYLKDQQLLGLWGCSGRIICTTNVPWNSSWSNKSYDEIWDSMTWLQWDREISNYSDIIYNLIEESQIQQEKNEQDLLALDNWASLWNWFNITKWLWYIKIFIMIVGGLIGLRIVFTVISMINRVRQGYSPLSFQTHNPNPGGPDRPGRIEEEGGEQDRDRSIRLVNGFLALAWDDLRNLCLFSYHRLRDFILIAARTVELVGHSSLKGLRLGWEGLKYLWNLLVYWGRELKISAISLFDTLAIVVAGWTDRIIELGQRFCRAILNVPTRIRQGAERALL

SEQ ID NO: 1222 - protein, 846 aa, Human Immunodeficiency Virus
MRVRGILRNYPQWWIWGILGFWMICNVVGNLWVTVYYGVPVWKEAKTTLFCASDAKAYETEVHNIWATHACVPTDPNPQEMELPNVTENFNMWKNDMVDQMHEDIISLWDQSLKPCVKLTPLCVTLNCTITNSSSIMTNCTFNTTTELKDKKRKASASFYRLDIVPLNGDSNGSSSGSYRLINCNTSTLTQACPKVSFDPIPIHYCAPAGYAILKCNDETFNGTGPCHNVSTVQCTHGIKPVVSTQLLLNGSLSEGEIIIRSENLTDNVKTIIVHLNKSIEINCIRTGNNTRRSIRIGPGQTFYATGDIIGDIRKAYCNISKHIWNKTLEEVATKLGAHFINKTIKFAPPSGGDLEITTHSFNCRGEFFYCNTTQLFNNISIGRFNTSIENDTNIILPCRIKQIINMWQEVGRAMYAPPIEGNITCRSNITGILLTRDGGNGGADNSTETFRPGGGNMKDNWRSELYKYKVVEIKPLGIAPTRAKRRVVEREKRAVGIGAVFLGFLGAAGSTMGAASITLTVQARQLLSGIAQQQSNLLRAIEAQQHMLQLTVWGIKQLQARVLAIERYLQDQQLLGIWGCSGKLICTTTVPWNSTWSNKSLDNIWDNMTWMQWDKEISNYTKTIYTLLENASIQQEQNEKDLLELDKWNTLWNWFNISNWLWYIRIFIMIVGGLIGLRIIFAILSIVNRVRQGYLPLSFQTLTPNQRGPDRLERIEEEGGGQGRNRSIRLVNGFLTLAWDDLRSLCLFSYHRLRDFILIAARAAELLGHSSLRGLQRGWEALKYLGSLVQYWGLELRKSAISLLDVTAIAVAEGTDRIIEIIQRICRAIRNVPNRIRQGFEAALL

SEQ ID NO: 1223 - protein, 858 aa, Human Immunodeficiency Virus
MRVRGILRNYQQWWIWGILGFWVLMICNGNLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVEIKPLGIAPTAAKRRVVEREKRAVGLGAVIFGFLGAAGSTMGAASITLTVQARQLLSGIVQQQSNLLKAIEAQQHLLQLTVWGIKQLQTRVLAIERYLKDQQLLGIWGCSGKLICTTAVPWNSSWSNKSHDEIWGNMTWMQWDREISNYTNTIYRLLEDSQNQQEQNEKDLLALDSWENLWNWFSITKWLWYIKIFIMIVGGLIGLRIIFAVLSVVNRVRQGYSPLSFQTLIPNPRGPDRPGRIEEEGGEQDRGRSTRLVSGFLALVWDDLRSLCLFSYHRLRDFTLVAARVVELLGRSSLKGLQKGWEALRYLGSLVQYWGLELKKSAISLFDTIAIAVAEGTDRIIELAQGIGRAIINIPRRIRQGFEAALQ

SEQ ID NO: 1224 - protein, 856 aa, Human Immunodeficiency Virus
MRVRGTLRNYQQWWIWGVLGFWMLMVCNVVGNLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVEIKPLGVAPTAAKRRVVQREKRAVGLGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNTSWSNRSQADIWGNMTWMQWDREISNYTNTIFRLLEDSQIQQESNEKDLLALDSWKNLWSWFDITNWLWYIKIFIMIVGGLIGLRIIFAVLSIVNRVRQGYSPLSFQTLIPNPRGPDRLGRIEEEGGEQDRDRSIRLVNGFLALAWDDLRSLCLFCYHQLRDFISVTTRAVELLGRSSLRGLQRGWEALKYLGSLVQYWVLELKKSAISLFDTIAIAVAEGTDRVIELIQRTCRAIRNIPRRIRQGFEAALQ

SEQ ID NO: 1225 - protein, 837 aa, Human Immunodeficiency Virus
MKVMGIPKNWPRWWMWGILGLWMLLICNGEDLWVTVYYGVPVWKEANPTLFCASDAKAYKTEMHNVWATHACVPTDPNPQEMVLENVTEDFNMWKNGMVEQMHQDIISLWDQSLKPCVKLTPLCVTLNCTEVTRSSNGTINNNSTEMKNCSFNVTTDLRDKKKKEHALFYRLDIVPLDETNGTSSEYRLINCNTSTITQACPKVSFDPIPIHYCAPAGYAILKCKDKKFNGTGPCKNVSTVQCTHGIKPVVSTQLLLNGSIAEGEIIIRSENLTNNAKIIIVQLNVTVEINCTRPNNNTRRSIRIGPGQTFYATGEIIGDIRQAHCNISREKWNRTLQKVEKKLEELFPNKTIHFTSSSGGDLEITTHSFNCMGEFFYCNTSALFNNNNDSTNSNITLPCRIRQFINMWQEVGRAMYAPPIQGVITCKSNVTGLLLTRDGGIINDTEIFRPGGGDMRDNWRSELYKYKVVEIKPLGIAPTTAKRRVVEREKRAVGIGAVFLGFLGAAGSTMGAASITLTAQARQLLSGIVQQQSNLLRAIEAQQHMLQLTVWGIKQLQTRVLAIERYLKDQQLLGIWGCSGKLICTTAVPWNGSWSNKSQDEIWHNMTWMQWDKEINNYTNIIYGLLEVSQNQQEKNEQDLLALDKWQNLWSWFNITNWLWYIKIFIMIVGGLIGLRIIFTVLSIVNRVRQGYSPLSFQTLIPNPRGPDRPRGIEEEGGEQDRSRSIRLVSGFLALAWDDLRSLCLFSYHRLRDLILIAARVVELLGQRGWEALKYLGSLVQYWGLELKKSAISLFDTIAIAVAEGTDRIIEVLQGIGRAICNIPRRIRQGFEAALQ

SEQ ID NO: 1226 - protein, 844 aa, Human Immunodeficiency Virus
MRVRGILRNWPQWWIWSILGFWMLIICRVMGNLWVTVYYGVPVWKEAKATLFCASDARAYEKEVHNVWATHACVPTDPNPQEIYLGNVTENFNMWKNDMVDQMHEDIISLWDQSLKPCVKLTPLCVTLRCTNATINGSLTEEVKNCSFNITTELRDKKQKAYALFYRPDVVPLNKNSPSGNSSEYILINCNTSTITQACPKVSFDPIPIHYCAPAGYAILKCNNKTFNGTGPCNNVSTVQCTHGIKPVVSTQLLLNGSLAEEDIIIKSENLTNNIKTIIVHLNKSVEIVCRRPNNNTRKSIRIGPGQAFYATNDIIGDIRQAHCNINNSTWNRTLEQIKKKLREHFLNRTIEFEPPSGGDLEVTTHSFNCGGEFFYCNTTRLFKWSSNVTNDTITIPCRIKQFINMWQGAGRAMYAPPIEGNITCNSSITGLLLTRDGGKTDRNDTEIFRPGGGNMKDNWRNELYKYKVVEIKPLGVAPTEARRRVVEREKRAVGIGAVLLGFLGAAGSTMGAASITLTVQARQLLSGIVQQQSNLLRAIEAQQHMLQLTVWGIKQLQTRVLAIERYLKDQQLLGLWGCSGKLICTTNVPWNSSWSNKSQTDIWDNMTWIQWDREISNYSNTIYKLLEGSQNQQEQNEKDLLALDSWNNLWNWFNITNWLWYIKIFIMIIGGLIGLRIILGVLSIVKRVRQGYSPLSFQTLTPNPRGLDRLGRIEEEGGEQDKDRSIRLVNGFLALAWEDLRSLCLFSYHRLRDFILIAVRAVELLGSSSLRGLQRGWEALKYLGSLLQYWGLELKKSAINLLDTVAIAVAEGTDRIIELIQRICRAIRNIPRRIRQGFEAALL

SEQ ID NO: 1227 - protein, 876 aa, Human Immunodeficiency Virus
MRVRGTLRNCQQWWIWGVLGFWMLMICNVGGNMWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVEIKPLGVAPTEAKRRVVEREKRAVGIGAVFLGFLGAAGSTMGAASITLTVQARQLLSGIVQQQSNLLRAIEAQQHMLQLTVWGIKQLQTRVLAIERYLKDQQLLGIWGCSGKLICTTAVPWNSSWSNKSHEEIWNNMTWMQWDREISNYTNIIYNLLEESQNQQERNEKDLLALDSWKNLWNWFNITNWLWYIKLFIMIVGGLIGLRIIFAVLSIVNRVRQGYSPLPFQIRTPNPGGPDRLGRIEEDGGEQDKDRSIRLVSGFLALAWDDLRSLCLFSYHRLRDFILVTARVVELLGRSSLRGLQKGWEALKYLGSLVQYWGLELKKSATSLFDTIAIAVAEGTDRIIELGLSICRAIRHIPRRIRQGFEAALQ

SEQ ID NO: 1228 - protein, 857 aa, Human Immunodeficiency Virus
MRVRGIPRNWPQWWTWGILGFWMIIMCKVAGNSWVTVYYGVPVWTEAKTTLFCASDAKAYEKEVHNVWATHACVPTDPNPQEIFLKNVTENFNMWKNDMVDQMHEDIISLWDQSLKPCVKLTPLCVTLNCVTYNNSMNSSATYNNSMNGEIKNCSFNTTTELRDKKQKVYALFYRTDVVPLNNNNNNSEYILINCNTSTITQACPKVSFDPIPIHYCAPAGYAILKCTDKKFNGTGSCNNVSTVQCTHGIKPVVSTQLLLNGSLAEEEIIIKSENLTDNIKTIIVQLNQSIGINCTRPNNNTRKSVRIGPGQTFYATGDIIGDIRQAHCNISRNQWNETLEQVKKKLGEHFHNQTKIKFEPPSGGDLEITTHSFNCRGEFFYCNTADLFTNATKLVNDTENKAVITIPCRIKQIINMWQGVGRAMYAPPIEGNITCNSNITGLLLTRDGGGNVTEINRTEIFRPGGGNMKDNWRNELYKYKVVEIKPLGVAPTGAKRKVVKREKRAVGLGAVLFGFLGAAGSTMGAASITLTAQARQLLSGIVQQQSNLLRAIEAQQHMLQLTVWGIKQLQARVLAIERYLKDQQLLGLWGCSGKLICTTNVPWNSSWSNKSQTDIWNNTTWMQWEREISNYTDTIYRLLEDSQNQQEENEKDLLALDRWQNLWNWFDITNWLWYIKIFIMIVGGLIGLRIIFGVLSIVKRVREGYSPLSFQTLTPTPRGLDRLGRIEEEGGEQDKDRSIRLVNGFLALAWDDLRSLCLFSYHQLRDFILIAARAVELLGRSSLRGLQKGWEALKYLGNLIQYWGLELKRRAINLLDISAIAVAEGTDRIIDIVLRTGRAIRNIPRRIRQGFGATLL

SEQ ID NO: 1229 - protein, 858 aa, Human Immunodeficiency Virus
MRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVEIKPLGVAPTKSKRKVVGREKRAVGLGAVLLGFLGAAGSTMGAASITLTVQARQLLSGIVQQQSNLLRAIEAQQHLLQLTVWGIKQLQTRVLAIERYLKDQQLLGLWGCSGKLICATAVPWNSSWSNKSLGDIWDNMTWMQWDREISNYTNTIFRLLEDSQNQQEKNEKDLLALDSWKNLWNWFDITNWLWYIKIFIMIVGGLIGLRIIFGVLAIVKRVRQGYSPLSFQTLIPNPRGPDRLGRIEEEGGEQDKDRSIRLVSGFLALAWDDLRSLCLFSYHQLRDFILTAARAAELLGRSSLRGLQRGWEVLKYLGNLVQYWGLELKRSAINLFDTIAIAVAEGTDRIIEVIQRICRAIRYIPTRIRQGFEAALL

SEQ ID NO: 1230 - protein, 850 aa, Human Immunodeficiency Virus
VMGIRKNWQQLWIWGILGFGMLMICDMKGLWVTIYYGVPVWKEAKTTLFCASEAKAYEKEVHNVWATHACVPTDPNPQEMVLENVTENFNMWKNDMVNQMHEDIISLWDQSLKPCVKLTPLCVTLNCTNANGTNNNGTVNVNDTMYGEIKNCSFNMTTELRDKKKQVYALFYKLDIVSLNENSNNSSEYRLINCNTSVITQACPKVTFDPIPIHYCAPAGYAILKCNNKTFTGIGPCKNVSTVQCTHGIKPVVSTQLLLNGSLAEEEIIVRSENLTDNVKTIIVHLNESVEIVCTRPNNNTRKSVRIGPGQTFYATGAIIGDIRQAHCNISTIKWNKTLQGVEKKLKEHFPNKTIEFKPSSGGDLEITTHSFNCRGEFFCCNTSNLFTSNLFTDNLTNTTNITLPCRIKQIINMWQGVGRAMYAPPIAGNITCKSNITGLLLTRDGGENNRTETFRPGGGDMKDNWRSELYKYKVVEIKPLGVAPTGANRRVVEREKRAVGIGAVFLGFLGAAGSTMGAASITLTVQARQLLSGIVQQQSNLLRAIEAQQHMLQLTVWGIKQLQARVLAIERYLRDQQLLGMWGCSGKLICTTAVPWNSSWSNKTYNDIWNNMTWMQWDREISNYTDTIYRLLEDSQNQQERNEKDLLALDSWNNLWNWFNITNWLWYIKIFIMIVGGLIGLRIIFAVLSIVNRVRQGYSPLSFQTLTPNPRGLDRLGGIEEEGGEQDRDRSIRLVSGFLPLAWDDLRSLCLFSYHQLRDFILIVARAVELLGRSSLRGLQRGWEALKYLGSLVQYWGLELKRSAISLLDTIAITVAEGTDRLIEVVQRIRRAICNIPRRIRQGFETALL

SEQ ID NO: 1231 - protein, 842 aa, Human Immunodeficiency Virus
MRVREIPRNYQQWWIWGILGFWMLMICSVVGNLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVEIKPLGIAPTKAKRRVVEREKRAVGLGAMFLGFLGAAGSTMGAASITLTVQARQLLSGIVQQQNNLLRAIEAQQHMLQLTVWGIKQLQARVLAIERYLKDQQLLGLWGCSGKLVCTTAVPWNSSWSNKSQEDIWNNTTWMQWDKEVSNYTKTIYKLLEKSQNQQEENEKDLLALDSWNNLWNWFDISNWLWYIKIFIMIVGGLIGLRIIFAVLSIVNRVRQGYSPLSFQTLTQNPRGLDRLGRIEEEGGEQDRDRSVRLVNGFLALFWDDLRSLCLFSYHRLRDFILIATRVVELLGRSSLKGLQRGWEALRYLGSRVQYWGLELKKSAISLFDTIAIAVAEGTDRIIELIQRSWRAIRNIPRRIRQGFETALL

SEQ ID NO: 1232 - protein, 845 aa, Human Immunodeficiency Virus
MRVKGMKRNWQQWWIWGILGFWMLYSGMGSLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTITQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRAMYAPPIPGRITCNSSITGLILTRDGGENTTDNGTEIFRPGGGDMRDNWRSELYKYKVVEIKPLGIAPTEAKRRVVEREKRAVGIGAVFLGFLGAAGSTMGAASITLTVQARQLLSGIVQQQSNLLRAIEAQQHMLQLTVWGIKQLQARVLAIERYLKDQQLLGIWGCSGKLICTTNVPWNSSWSNKSLGDIWDNMTWMEWDREISNYTNIIFGLLEDSQNQQERNEKDLLALDKWNNLWNWFNITQWLWYIKIFIMIVGGLIGLRIIFAVLSIVNRVRQGYSPLSFQTLFPNPRELDRLGRIEEEGGEQDKGRSIRLVSGFLTLAWDDVRSLCLFSYHRLRDCILIVARVVELLGRSSLRGLQQGWETLKYLGSLVQYWGQELKKSAISLLDTIAIAVAEGTDRIIEIIQRICRAIRNIPRRIRQGFEAALQ

SEQ ID NO: 1233 - protein, 857 aa, Human Immunodeficiency Virus
MKVREILRNWRQWWIWGILGFWMLMICNVVVGNLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSAMTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRAMYAPPIAGNITCVSNITGLLLVRDGGNGDTNDTETFRPGGGDMKNNWRSELYKYKVVEIKPLGVAPTEAKRRVVEREKRAVGIGAVLLGFLGAAGSTMGAASITLTAQARQVLSGIVQQQSNLLRAIEAQQHLLQLTVWGIKQLQTRVLALERYLKDQQLLGLWGCSGRLICTTAVPWNSSWSNKSLTDIWDNMTWMQWDKEVSNYTNTIYRLLEDSQSQQEKNEKDLLALDSWKNLWTWFDISNWLWYIKIFIMVVGGLIGLRIIFAVISIVNRVRQGYSPLSLQTLTQSPGGPDRLGRIEEEGGEQDRDRSIRLVNGFLTLAWDDLRSLCLFSYHRLRDFILIAARVVELLGHSSLRGLQKGWEALKYLGSLVQYWCLELKRSAISLLDSIAMAVAEGTDRIIELVQRICRGIYHIPRRIRQGFEAALQ

SEQ ID NO: 1234 - protein, 848 aa, Human Immunodeficiency Virus
MRVKGIQRNSQHLLKWGMIILGMMIICSATEKLWVTVYYGVPVWREAKATLFCASDAKAYDTEVHNVWATHACVPTDPNPQEIILENVTENFNMWKNNMVEQMHEDIISLWDQSLKPCVKLTPLCVTLNCTDVTVNGTIVKVNSTGMKNCSFNITTEIRDKKKKESALFYRLDIVPLDESSDSSSNYSEYRLISCNTSTITQACPKVTFDPIPIHYCAPAGYAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRAIYAPPIAGNITCTSDITGLLLTRDGGSDGNSTKETFRPGGGDMRDNWRSELYKYKVVEIKPLGVAPTKAKRRVVEREKRAVGIGAVFFGFLGAAGSTMGAASITLTVQARQLLSGIVQQQSNLLRAIEAQQHMLQLTVWGIKQLQTRVLAIERYLKDQQLLGIWGCSGKLICTTTVPWNSSWSNKTQNDIWDNMTWMQWDREINNYTNTIYRLLEESQNQQEKNEQDLLALDKWDNLWSWFSITKWLWYIKIFIMIVGGLIGLRIIFAVLSIVNRVRQGYSPLSFQTLIPSPREPDRPGRIEEEGGEQDRNRSTRLVSGFLALAWDDLRSLCLFSYHLLRDFILIAARTVELLGRSSLRGLQRGWETLKYLGSLVQYWGLELKKSAISLFDTIAIHVAEGTDRIIELVQGICRAIYNIPVRIRQGFEAALQ

SEQ ID NO: 1235 - protein, 855 aa, Human Immunodeficiency Virus
MRVKGILRNCQQWWIWGILGFWMVMTYSVVGNLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPIGVAPTKARRRVVQREKRAVGLGAVFIGFLGAAGSTMGAASVTLTVQARQLLAGIVQQQSNLLRAIEAQQHMLKLTVWGIKQLQARVLAVERYLRDQQLLGIWGCSGKLVCNTNVPWNSSWSNKSLSEIWENMTWLQWDKEINNYTQIIYTLIEESQTQQEKNEQELLALDKWANLWNWFDISNWLWYIRIFIMIVGGLIGLRIVFVVLAVINRVRQGYSPLSFQTHTPSPAGPDRPGRIEEEGGEQGRGKSIRLVSGFLALAWEDLRSLCLFSYHRLRDFILIAARVVEVLGRSSLRGLQRGWEALKYLGSLMQYWGLELKKNAISLLDIVAIAVAEGTDRIIEFIQGICRAIRNISRRIRQGFEAALQ

SEQ ID NO: 1236 - protein, 860 aa, Human Immunodeficiency Virus
MKVKETQMNWLNLWRWGTLILGLVMICSASDKLWVTVYYGVPVWRDADTTLFCASDAKVHSTEVHNVWATHACVPTDPNPQEIHLENVTENFNMWQNKMAEQMQEDVISLWDQSLKPCIKLTPLCVTLSCTEAKFNETFNKIDNITKVSNLTDEMRNCSFNMTTELRDKKQQVYALFYKLDIVPIDNSSEYRLINCNTSVIKQACPKVSFDPIPIHYCTPAGYAILKCNDKNFNGTGPCKNVSSVQCTHGIKPVVSTHLLLNGSLAEEEIVIRSEDITKNTKTIIVHLNKSVEINCTRPSNNTRTSVRIGPGQVFYRTGEVITSIRKAYCEINGTKWNETLRQVAKKLKEHFKNKTIIFQPPSGGDLEVTTHHFNCRGEFFYCDTAQLFNSTWRGNETKEERNGTSNDIIILPCRIKQIVRMWQGVGQSMYAPPISGIINCVSNITGILLTSDGDGGPTADNETFRPAGGDMRDNWRSELYKYKVVQIEPLGIAPTRAKRRVVDREKRAVGIGAMIFGFLGAAGSTMGAASITLTVQARQLLSGIVQQQSNLLRAIEVQQHLLQLTVWGIKQLQARVLAVERYLKDQKFLGLWGCSGKIICTTAVPWNSTWSNKSYEDIWYNMTWIEWEREISNYTSQIYEILTESQNQQDRNEKDLLELDKWASLWNWFDITNWLWYIKIFIMIVGGLIGLRIIFAVLSIVNRVRQGYSPLSLQIPTRHQREPDRPEGIEEGGGEQGRDRSVRLVSGFLALAWDDLRSLCLFSYHRLRDFILIVARTVELLGRSSLKGLRRGWEGLKYLGNLLLYWSQELKISAISLLDATAIAVAGWTDRIIEVAQRAWRAFLHIPRRIRQGLERALL

SEQ ID NO: 1237 - protein, 857 aa, Human Immunodeficiency Virus
MRVKETQMNWPNLWRWGTLILGLVIICSASDNLWVTVYYGVPVWKDADTTLFCASDAKAHETEAHNIWATHACVPTDPNPQEIYMENVTENFNMWKNNMVEQMQEDIISLWDQSLKPCVKLTHLCVTLSCTNVTLTNVNYTNNFPNIGNITDEVRNCSFNVTTEIRDKKQKVYALFYKTDIVQMENKNSYRLINCNTSVIKQACPKISFDPIPIHYCTPAGYAILKCNEKNFNGTGPCKNVSSVQCTHGIKPVVSTQLLLNGSLAEGEIIIRSENLTNNAKTIIVHLNKSVEINCTRPSNNTRTSVTIGPGQVFYRTGDIIGDIRKAYCEINGTKWNETLKQVVGKLKEHFPNKKISFQPPSGGDLEITMHHFNCRGEFFYCNTTQLFNSTWINSTGIKEYNDTIIYLPCKIKQIINMWQGVGQAMYAPPIRGKINCVSNITGILLTRDGGDANATNDTETFRPGGGNIKDNWRSELYKYKVVQIEPLGIAPTKAKRRVVEREKRAVGIGAMIFGFLGAAGSTMGAASITLTVQARQLLSGIVQQQSNLLRAIEAQQHLLQLTVWGIKQLQARVLAVERYLKDQKFLGLWGCSGKIICTTAVPWNSTWSNKSFEQIWNNMTWIEWEREISNYTSQIYDILTESQNQQDRNEKDLLELDKWASLWNWFDITKWLWYIKIFIMIVGGLIGLRIIFTVLSIVNRVRQGYSPLSFQTPTHHQREHDRPGRIEEEGGEQGRDRSVRLVSGFLALAWDDLRSLCLFSYHRLRDFILIAARTVELLGHSSLKGLRRGWEGLKYLGNLLTYWSQELKISAISLFDAIAVAVAGWTDRVIEVAQGAWRAILHIPRRIRQGLERALL

SEQ ID NO: 1238 - protein, 853 aa, Human Immunodeficiency Virus
MRVKETQMNWPNLWKWGTLILGLVIICSASDNLWVTVYYGVPVWRDADTTLFCASDAKAQETEAHNIWATHACVPTDPNPQEIHLENVTENFNMWKNNMVEQMQEDVISLWDQSLKPCVKLTPLCVTLNCTTAKVINATIPANVSNIMGNITDEVRNCSFNMTTELRDRKQKAYALFYKLDIVQIKDNKNSSSEYRLINCNTSVIKQACPKVSFDPIPIHYCTPAGYALLKCNDKNFNGTGPCNNVSSVQCTHGIKPVVSTQLLLNGSLAEEEIIISSENLTNNAKTIIVHLNKSVEINCTRPSVNTRTSMHIGPGQVLYRTGDIIGDIRNAYCEIDGTKWSEALELVTEKLKKHFSEIKFQPPSGGDLEITMHHFNCKGEFFYCNTSQLFNNNHKECNGTITLPCRIKQIINMWQGAGQAMYAPPISGKINCVSNITGILLTRDGGTNNNTNSSETFRPGGGNIKDNWRSELYKYKVVQIEPLGIAPTRAKRRVVEREKRAVGIGAMIFGFLGAAGSTMGAASLTLTVQARQLLSGIVQQQSNLLRAIEAQQHLLQLTVWGIKQLQARVLAVERYLKDQKLLGLWGCSGKIICTTAVPWNSTWSNKSYKEIWDNMTWTQWEREISNYTNQIYDILTESQNQQDRNEKDLLELDKWASLWNWFDITNWLWYIRIFIMIVGGLIGLRIIFAVLSIVNRVRQGYSPLSFQIPTHHQREADRPERIEEGDGEQGRDRSVTLVSGFLALIWDDLRSLCLFSYHRLRDFILIATRTVELLGHSSLKGLRRGWEGLKHLGNLLLYWGQELKISAISLLNATAIAVAEWTDRVIEVAQRAWRAFIHIPRRIRQGLERLLL

SEQ ID NO: 1239 - protein, 845 aa, Human Immunodeficiency Virus
MRVKETQMNWPNLWKWGVLILGLVIICSASDKLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVIKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQAMYAPPISGAINCLSNITGILLTRDGGGNNRSNETFRPGGGNIKDNWRSELYKYKVVEIEPLGIAPTKAKRRVVEREKRAVGIGAMIFGFLGAAGSTMGAASITLTVQARQLLSGIVQQQSNLLRAIEAQQHMLQLTVWGIKQLQARVLAVERYLKDQRFLGLWGCSGKTICTTAVPWNSTWSNKTYEEIWDNMTWTQWEREISNYTNQIYSILTESQSQQDKNEKDLLELDKWASLWNWFTLSRWLWYIKIFIMIVGGLIGLRIIFAVLSIVNRVRQGYSPLSFQTPILQQREPDRPERIEEGGGEQGRDTSVRFVSRFLALAWEDLRNLCLFSYHRLRDLLLIATRTVEILGHYSLKGLRRGWEVLKYLGNLLLYWGQELKTSAISLLDATAIATAEWTDRVIEVAQRAWRAFIHIPRRIRQGFERALL

SEQ ID NO: 1240 - protein, 855 aa, Human Immunodeficiency Virus
VKETQMNWPNLWKWGILILGLVIICSASDNLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVQIEPLGIAPTRAKRRVVEREKRAVGIGAMIFGFLGAAGSTMGAASITLTVQARQLVSGIVQQQSNLLRAIEAQQHLLQLTVWGIKQLQARVLAVERYLKDQKFLGLWGCSGKIICTTAVPWNSTWSNRSFEEIWSNMTWIEWEREISNYTNQIYEILTESQNQQDRNEKDLLELDKWASLWSWFDITNWLWYIKIFIMIVGGLIGLRIIFAVLSIVNRVRQGYSPLSFQTPIHQQREPDRPERIEEGGGEQGRDRSVRLVTGFLALAWDDLRSLCLFSYHRLRDFISIAARTVELLGRSSLKGLRRGWEGLKYLGNLLLYWGQELKISAISLLNATAIAVAGWTDRVIEVAQGIWRAILHIPRRIRQGLERALL

SEQ ID NO: 1241 - protein, 860 aa, Human Immunodeficiency Virus
MRVRETRKNYQHLWWKWGMMLLGMLMICSAVEQTWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVITQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKAMYAPPISGQIRCSSNITGLLLTRDGGRGNQTDNQTEIFRPVGGDMKNNWRSELYKYKVVRIEPLGIAPTRAKRRVVQREKRAVGIGALFLGFLGAAGSTMGAASMTLTVQARLLLSGIVQQQNNLLRAIEAQQHLLQLTVWGIKQLQARVLAVERYLRDQQLLGIWGCSGKLICTTAVPWNVSWNNRSVDDIWENMTWMQWDREISNYTSLIYTLIEESQNQQEKNEQELLALDKWANLWNWFNITEWLWYIKIFIMIVGGLVGLRIVFAVLSIVNRVRQGYSPLSFQTHLPAQRGPDRPGGIEEEGGESDRDRSGRLVNGFLAIIWIDLRSLCLFSYHHLRDLLLIVTRIVEILGRRGWEILKYWWNLLQYWIQELKNSAVSLLNAIAIAVGEGKDRIIEAFRSIFRAILHIPTRIRQGLERSLL

SEQ ID NO: 1242 - protein, 859 aa, Human Immunodeficiency Virus
MRVTGIKKNYWHLWRWGTLLLGMLMICSAVKDRWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSAITQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQAMYAPPIKGNIACKSNITGLLLTRDGGRSNETNDTETFRPEGGNMKDNWRSELYKYKVVEIKPLGVAPTEAKRRVVKREKRAALGAVFLGFLGLAGSTMGAASIALTAQARQLLSGIVQQQSNLLRAIEAQQHLLQLTVWGIKQLQTRVLAIERYLTDQQLLGMWGCSGKLICTTAVPWNTSWSNKSLEKIWKNMTWMQWDKEISNYTDTIYRLLEVSQNQQEENEKDLLALDNWKSLWNWFDITNWLWYIKIFIMIVGGLIGLRIIFAVLSIVNRVRQGYSPLSFQTLTPNPGGPDRLGRIEEEGGEQDKDRSIRLVSGFLALAWDDLRNLCLFSYHRLRDFILVATRVVELLGRNSLRVLQRGWEALKYLGSLVQYWGQELKKSAISLFDTIAIAVAEGTDRIIKLVQRLCRAIYNIPRRIRQGFEAALQ

SEQ ID NO: 1243 - protein, 855 aa, Human Immunodeficiency Virus
MRVTGTRKNYRHFWRWGTMLLGMLMICSAVGNLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSAITQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQAMYAPPIAGNITCSSNITGLLLERDGGRDINNTEIFRPGGGDMKNNWRSELYKYKVVEIKPLGVAPTTAKRRVVEREKRAVGIGAVFLGFLGVAGSTMGAASMTLTVQARQLLSGIVQQQSNLLRAIEAQQHMLQLTVWGIKQLQTRVLAIERYLKDQQLLGIWGCSGKLICPTAVPWNSSWSNKSQTEIWNNMTWMQWDKEISNYTNSIYRLLEESQNQQEKNEKDLLALDSWKNLWSWFDITNWLWYIKIFIMIVGGLIGLRIIFAVLSVVNRVRQGYSPLSFQTLTPNPGGPDRLERIEEGGGEQDKDRSIRLVSGFLALAWDDLRNLCLFSYHRLRDFILVATRVVELLGQRGWKALKYLGSLVQYWGQELKQRVIRLIDTIAIAVAEGTDRIIEAVQGFCRAIYHIPRRIRQGLEAALQ

SEQ ID NO: 1244 - protein, 623 aa, Artificial Sequence
  Recombinant HIV protein
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVCTQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRCMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1245 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTNNITDDMRGELKNCSFNMTTELRDKKQKVYSMFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDMIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1246 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDYIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1247 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNITNNITDDMRGELKNCSFNMTTELRDKKQKVYSWFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDFIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1248 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTWNITDDHRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1249 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTWNITDDFRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDLRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1250 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNITWNITDDFRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDLRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1251 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTFNITDDLRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1252 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEMKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPMNMTRKSIRIGPGQAFYALGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1253 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEFKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPLNMTRKSIRIGPGQAFYALGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1254 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEWKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPLNGTRKSIRIGPGQAFYAFGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1255 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCFKLTPLCVTLQCTNVTNNITDDMRGELKNCSFNMTTELRDKKQKVYSLFYRLDVVQINENQGNRSNNSNKEYRLINCNTSACTMACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFMATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1256 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCIKLTPLCVTLQCTNVTNNITDDMRGELKNCSFNMTTELRDKKQKVYSLFYRLDVVQINENQGNRSNNSNKEYRLINCNTSACTMACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFWATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1257 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCWKLTPLCVTLQCTNVTNNITDDMRGELKNCSFNMTTELRDKKQKVYSLFYRLDVVQINENQGNRSNNSNKEYRLINCNTSACTMACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFWATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1258 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCFKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGMAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1259 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCWKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGFAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1260 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFWRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRMKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1261 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFWRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRFAHCNVSKATWNETLGKVVKQLRKHFGNNTIIRFANSSGGDLEVTTHSFNCGGEFFYCNTSGLFNSTWISNTSVQGSNSTGSNDSITLPCRMKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1262 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSMKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINFWQRIGMCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1263 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSMKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINFWQRIGWCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1264 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINFWQRIGLCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1265 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTWNITDDHRGELKNCSFNMTTELRDKKQKVYSMFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDMIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1266 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNITWNITDDFRGELKNCSFNMTTELRDKKQKVYSWFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDFIGDLRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1267 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCFKLTPLCVTLQCTNVTNNITDDMRGELKNCSFNMTTELRDKKQKVYSLFYRLDVVQINENQGNRSNNSNKEYRLINCNTSACTMACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGMAFMATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1268 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCWKLTPLCVTLQCTNVTNNITDDMRGELKNCSFNMTTELRDKKQKVYSLFYRLDVVQINENQGNRSNNSNKEYRLINCNTSACTMACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGFAFWATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1269 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEMKNCSFNMTTELRDKKQKVYSLFWRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPMNMTRKSIRIGPGQAFYALGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRMKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1270 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEWKNCSFNMTTELRDKKQKVYSLFWRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPLNGTRKSIRIGPGQAFYAFGDIIGDIRFAHCNVSKATWNETLGKVVKQLRKHFGNNTIIRFANSSGGDLEVTTHSFNCGGEFFYCNTSGLFNSTWISNTSVQGSNSTGSNDSITLPCRMKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1271 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGFLKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1272 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGWLKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1273 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEFKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1274 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEWKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1275 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTFLRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1276 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTWLRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1277 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKFYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1278 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKWYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1279 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSFFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1280 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLWYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1281 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRFDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1282 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRWDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1283 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEFRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1284 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEWRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1285 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRFINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1286 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRWINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1287 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLWNCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1288 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNFSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1289 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNWSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1290 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACFQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1291 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACWQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1292 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQFCPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1293 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQWCPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1294 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNFTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1295 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNWTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1296 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTFKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1297 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTWKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1298 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSFRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1299 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSWRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1300 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGFAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1301 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGWAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1302 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQFINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1303 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRFGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1304 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRWGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1305 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGFCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1306 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGWCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1307 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYMPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1308 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYFPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1309 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYWPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1310 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPWCVTLQCTNVTNNITDDMRGELKNCSFNMTTELRDKKQKVYSLFYRLDVVQINENQGNRSNNSNKEYRLWNCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1311 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNIWIDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIIWIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1312 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSAEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1313 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSSEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1314 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGPCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1315 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLCVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNCQEKNEQDLLALD

SEQ ID NO: 1316 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTCKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPICGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1317 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSYNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1318 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIYGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1319 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSYNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIYGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1320 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGWAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1321 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARLLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1322 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLALERYLRDQQLLGIWGCSGKLICCTNVPWNSSWSNRNLSEIWDNMTWLQWDKEISNYTQIIYGLLEESQNQQEKNEQDLLALD

SEQ ID NO: 1323 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARLLALERYLRDQQLLGIWGCSGKLICCTNVPWNSSWSNRNLSEIWDNMTWLQWDKEISNYTQIIYGLLEESQNQQEKNEQDLLALD

SEQ ID NO: 1324 - protein, 634 aa, Artificial Sequence
  Recombinant HIV protein
AENLWVTVYYGVPVWKDAETTLFCASDAKAYETEKHNVPATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1325 - protein, 634 aa, Artificial Sequence
  Recombinant HIV protein
AENLWVTVYYGVPVWKDAETTLFCASDAKAYETEKHNPWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1326 - protein, 634 aa, Artificial Sequence
  Recombinant HIV protein
AENLWVTVYYGVPVWKDAETTLFCASDAKAYETEKHNVWAPHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1327 - protein, 634 aa, Artificial Sequence
  Recombinant HIV protein
AENLWVTVYYGVPVWKDAETTLFCASDAKAYETEKHNVWATHACWPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1328 - protein, 634 aa, Artificial Sequence
  Recombinant HIV protein
AENLWVTVYYGVPVWKDAETTLFCASDAKAYETEKHNVWATHACFPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1329 - protein, 634 aa, Artificial Sequence
  Recombinant HIV protein
AENLWVTVYYGVPVWKDAETTLFCASDAKAYETEKHNVWATHACMPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1330 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKWSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1331 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKFSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1332 - protein, 634 aa, Artificial Sequence
  Recombinant HIV protein
AENLWVTVYYGVPVWKDAETTLFCASDCKAYETEKHNVWATHACVPCDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1333 - protein, 634 aa, Artificial Sequence
  Recombinant HIV protein
AENLWVTVYYGVPVWKDAETTLFCASCAKAYETEKHNVWATHACVPCDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1334 - protein, 634 aa, Artificial Sequence
  Recombinant HIV protein
AENLWVTVYYGVPVWKDAETTLFCASDAKAYETEKHPVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1335 - protein, 634 aa, Artificial Sequence
  Recombinant HIV protein
AENLWVTVYYGVPVWKDAETTLFCASDAKAYETEKPNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1336 - protein, 634 aa, Artificial Sequence
  Recombinant HIV protein
AENLWVTVYYGVPVWKDAETTLFCASDAKAYETEKPPVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1337 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLIDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1338 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLMDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1339 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMIQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1340 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMMQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1341 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQNIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1342 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQLIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1343 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMMQLIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1344 - protein, 635 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTCACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGCQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1345 - protein, 634 aa, Artificial Sequence; identical to SEQ ID NO: 183
  Recombinant HIV protein

SEQ ID NO: 1346 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQWFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1347 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRWGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1348 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQWLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1349 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKWCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1350 - protein, 634 aa, Artificial Sequence
  Recombinant HIV protein
AENLWVTVYYGVPVWKDAETTLFCASDAKAYETEKHNVWYTHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1351 - protein, 634 aa, Artificial Sequence
  Recombinant HIV protein
AENLWVTVYYGVPVWKDAETTLFCASDAKAYETEKHNVWFTHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1352 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISYWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1353 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISFWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1354 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACPQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1355 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCTKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1356 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGTKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1357 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 1358 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGTKQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 1359 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGTEQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 1360 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGTTQLQARVLAVERYLRDQQLLNIWGCSGKLICCTNVPWNSSWSNRNLSEIWDNMTWLQWDKEISNYTQIIYGLLEESQNQQEKNEQDLLALD

SEQ ID NO: 1361 - protein, 634 aa, Artificial Sequence; identical to SEQ ID NO: 186
  Recombinant HIV protein

SEQ ID NO: 1362 - protein, 634 aa, Artificial Sequence; identical to SEQ ID NO: 190
  Recombinant HIV protein

SEQ ID NO: 1363 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNYLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1364 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTYTVQARNYLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1365 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGWAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNYLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1366 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGWAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTYTVQARNYLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1367 - protein, 633 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1368 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLWNCNMSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIIFMWQRIGQGMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1369 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNMSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIIFMWQRIGQGMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1370 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLWNCNYSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIIFMWQRIGQGMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1371 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLFNCNLSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIIWMWQRIGQMMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1372 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTNNITDDMRGELKNCSFNMTTELRDKKQKVYSMFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDMIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1373 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDYIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1374 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNITNNITDDMRGELKNCSFNMTTELRDKKQKVYSWFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDFIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1375 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTWNITDDHRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1376 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTWNITDDFRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDLRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1377 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNITWNITDDFRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDLRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1378 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTFNITDDLRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1379 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEMKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPMNMTRKSIRIGPGQAFYALGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1380 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEFKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPLNMTRKSIRIGPGQAFYALGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1381 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEWKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPLNGTRKSIRIGPGQAFYAFGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1382 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCFKLTPLCVTLQCTNVTNNITDDMRGELKNCSFNMTTELRDKKQKVYSLFYRLDVVQINENQGNRSNNSNKEYRLINCNTSAITMACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFMATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1383 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCIKLTPLCVTLQCTNVTNNITDDMRGELKNCSFNMTTELRDKKQKVYSLFYRLDVVQINENQGNRSNNSNKEYRLINCNTSAITMACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFWATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1384 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCWKLTPLCVTLQCTNVTNNITDDMRGELKNCSFNMTTELRDKKQKVYSLFYRLDVVQINENQGNRSNNSNKEYRLINCNTSAITMACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFWATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1385 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCFKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGMAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1386 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCWKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGFAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1387 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFWRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRMKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1388 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFWRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRFAHCNVSKATWNETLGKVVKQLRKHFGNNTIIRFANSSGGDLEVTTHSFNCGGEFFYCNTSGLFNSTWISNTSVQGSNSTGSNDSITLPCRMKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1389 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSMKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINFWQRIGMAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1390 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSMKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINFWQRIGWAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1391 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINFWQRIGLAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1392 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNFTWNITDDHRGELKNCSFNMTTELRDKKQKVYSMFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDMIGDMRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1393 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNITWNITDDFRGELKNCSFNMTTELRDKKQKVYSWFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDFIGDLRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1394 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCFKLTPLCVTLQCTNVTNNITDDMRGELKNCSFNMTTELRDKKQKVYSLFYRLDVVQINENQGNRSNNSNKEYRLINCNTSAITMACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGMAFMATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1395 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCWKLTPLCVTLQCTNVTNNITDDMRGELKNCSFNMTTELRDKKQKVYSLFYRLDVVQINENQGNRSNNSNKEYRLINCNTSAITMACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGFAFWATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1396 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEMKNCSFNMTTELRDKKQKVYSLFWRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPMNMTRKSIRIGPGQAFYALGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRMKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1397 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGEWKNCSFNMTTELRDKKQKVYSLFWRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPLNGTRKSIRIGPGQAFYAFGDIIGDIRFAHCNVSKATWNETLGKVVKQLRKHFGNNTIIRFANSSGGDLEVTTHSFNCGGEFFYCNTSGLFNSTWISNTSVQGSNSTGSNDSITLPCRMKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1398 - protein, 623 aa, Artificial Sequence
  Recombinant HIV protein
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVEVKPLGVAPTNCRRRVVGRRRRRRAVGMGAVFLGFLGAAGSTMGAASITLTVQARQLLSGIVQQQSNLLKAPEAQQHMLKLTVWGIKQLQARVLALERYLKDQQLLGMWGCSGKLICCTNVYWNSSWSNKTYGDIWDNMTWMQWEREISNYTEIIYELLEESQNQQEKNEQDLLALD

SEQ ID NO: 1399 - protein, 623 aa, Artificial Sequence
  Recombinant HIV protein
AENLWVTVYYGVPVWKDAETTLFCASDAKAYEKEKHNVWATHACVPTDPNPQEMVLKNVTENFNMWKNDMVDQMHTDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQRVGQAMYAPPIAGNITCISNITGLLLTRDGGKNNTETFRPGGGNMKDNWRSELYKYKVVEVKPLGVAPTRCRRRVVGRRRRRRAVGMGAVFLGFLGAAGSTMGAASITLTVQARQLLSGIVQQQSNLLKAPEAQQHMLKLTVWGIKQLQARVLALERYLKDQQLLGMWGCSGKLICCTNVYWNSSWSNKTYGDIWDNMTWMQWEREISNYTEIIYELLEESQNQQEKNEQDLLALD

SEQ ID NO: 1400 - protein, 619 aa, Artificial Sequence
  Recombinant HIV protein
AENLWVTVYYGVPVWKEANPTLFCASDAKAYKTEMHNVWATHACVPTDPNPQEMVLENVTEDFNMWKNGMVEQMHQDIISLWDQSLKPCVKLTPLCVTLNCTEVTRSSNGTINNNSTEMKNCSFNVTTDLRDKKKKEHALFYRLDIVPLDETNGTSSEYRLINCNTSTCTQACPKVSFDPIPIHYCAPAGYAILKCKDKKFNGTGPCKNVSTVQCTHGIKPVVSTQLLLNGSIAEGEIIIRSENLTNNAKIIIVQLNVTVEINCTRPNNNTRRSIRIGPGQTFYATGEIIGDIRQAHCNISREKWNRTLQKVEKKLEELFPNKTIHFTSSSGGDLEITTHSFNCMGEFFYCNTSALFNNNNDSTNSNITLPCRIRQFINMWQEVGRCMYAPPIQGVITCKSNVTGLLLTRDGGIINDTEIFRPGGGDMRDNWRSELYKYKVVEIKPLGIAPTTCKRRVVGRRRRRRAVGIGAVFLGFLGAAGSTMGAASITLTAQARQLLSGIVQQQSNLLRAPEAQQHMLQLTVWGIKQLQTRVLAIERYLKDQQLLGIWGCSGKLICCTAVPWNGSWSNKSQDEIWHNMTWMQWDKEINNYTNIIYGLLEVSQNQQEKNEQDLLALD

SEQ ID NO: 1401 - protein, 629 aa, Artificial Sequence
  Recombinant HIV protein
AENLWVTVYYGVPVWKEASPTLFCASDAKAYDTEVHNVWATYACVPTDPNPQELVMENVTENFNMWKNDMVEQMHQDIISLWDEGLKPCVKLTPLCVTLHCSSNVTSNSNVTSNSTDASKVNKDIIGQMKNCSFNITTEVRDKNKKAYALFYRLDIVPLTADNSSGEYRLINCNTSTCTQACPKVSFDPIPLHYCAPAGYAILKCNDKTFNGTGPCKNVSTVQCTHGIKPVVSTQLLLNGSIAEDKTIIRSENLTNNAKIIIVQLNEPVEINCTRPNNNTRQSIRIGPGQTFYATGEIIGDIRQAHCNISGDRWNKTLESVKERLQKQFPNKTILFAPSSGGDLEITTHSFNCRGEFFYCNTSKLFNTTGLSDNATLTIPCRIKQIINMWQEVGRCMYAPPIKGIITCRSNITGLLLTRDGGTNNTNNTETFRPGGGDMRDNWRSELYKYKVVEIKPLGVAPTGCKRAVVGRRRRRRAALGALFLGFLGAAGSTMGAASITLTVQARQLLSGIVQQQSNLLRAPEAQQHMLQLTVWGIKQLRTRVLAIERYLQDQQLLGIWGCSGKLICCTTVPWNSSWSNKSQEEIWENMTWMQWDREISNYTGTIYRLLEVSQNQQEKNEQDLLALD

SEQ ID NO: 1402 - protein, 628 aa, Artificial Sequence
  Recombinant HIV protein
AENLWVTVYYGVPVWKEATTTLFCASDAKAYETEVHNVWATHACVPTDLNPQEVVLENVTENFNMWKNNMVEQMHEDIISLWDQSLKPCVKLTPLCVTLNCTDNINTTQTNSSIMEKGEIKNCSFNVTTNIRDKMQKEYALFYKLDVISIKNDNSSYRLIDCNTSVCTQACPKVSFEPIPIHYCAPAGFAILKCNDKKFNGTGLCTNVSTVQCTHGIRPVVSTQLLLNGSLAEEEVVIRSENLTDNAKTIIVQLKEAVEINCTRPNNNTRKSINIGPGRAFVATGAIIGDIRQAHCNISRTKWNDTLKQVVTKLREKFGNKTIVFNQSSGGDAELVMHSFNCGGEFFYCNSTQLFNSTWSVNSTGNDTTEEPNITFPCRIKQIINMWQEVGKCMYNPPIKGIISCRSNITGLLLTRDGGNNNNTNTTETFRPEGGNMKDNWRSELYKYKVVKIEPLGVAPTKCKRRVVGRRRRRRAVGIGAVFLGFLGAAGSTMGAASVTLTVQARQLLSGIVQQQNNLLRAPEAQQHMLQLTVWGIKQLQARVLALERYLRDQQLLGIWGCSGKLICCTAVPWNTSWSNKSMDYIWGNMTWMQWEREISNYTYLIYTLLEESQNQQEKNEQELLKLD

SEQ ID NO: 1403 - protein, 643 aa, Artificial Sequence
  Recombinant HIV protein
AENLWVTVYYGVPVWKETTTTLFCASDARAYDTEVHNVWATHACVPTDPNPQEVVLGNVTENFNMWKNNMVEQMHEDIISLWDQSLKPCVRLTPLCVTLNCIDYYGNTTNSNNSSETMMEKGEIKNCSFNITTRLKDKMQKEYALFYKYDIVPIDNRVGNDTSNATSYRLTSCNTSVCTQACPKVSFEPIPIHYCAPAGFAILKCNDKKFNGTGPCKNVSTVQCTHGIKPVVSTQLLLNGSLAEEEVMIRSENFTDNAKTIIVQLNETVEINCTRPNNNTRKSIHMGPGKVFYTTGEIIGDIRQAHCNINRAKWNNTLIKIVEKLRVKFNKTISFKQSSGGDPEIEMHSFNCGGEFFYCNTTQLFNSTWFNNATLNVNSNVTEGSENITLPCRIRQIVNMWQEVGKCMYAPPIQGQIRCSSNITGLLLTRDGGGSNSSNTSEEVFRPGGGNMRDNWRSELYKYKVVKIEPLGIAPTKCKRRVVGRRRRRRAVGIGALFLGFLGAAGSTMGAASMTLTVQARQLLSGIVQQQNNLLRAPQAQQHLLQLTVWGIKQLQARVLAVERYLKDQQLLGIWGCSGKLICCTAVPWNASWSNKSLNEIWDNMTWMEWEKEIDNYTSLIYTLIEESQNQQEKNEQELLELD

SEQ ID NO: 1404 - protein, 635 aa, Artificial Sequence; identical to SEQ ID NO: 1057
  Recombinant HIV protein

SEQ ID NO: 1405 - protein, 636 aa, Artificial Sequence
  Recombinant HIV protein
AENLWVTVYYGVPVWKEATTTLFCASEAKAYDTEVHNVWATHACVPTDPNPQEVELGNVTENFNMWKNDMVEQMHEDIISLWDQSLKPCVRLTPLCVTLDCTDLNNTTNTNNTTNTNSSKIEGGEMKNCSFNITTNRGDKRQKEYALLYRTDIVSIENTSSSYRLISCNTSVCTQACPKVTFEPIPIHYCAPAGFAILKCNEDKFNGTGPCKNVSTVQCTHGIRPTVSTQLLLNGSLAKEEVIIRSANLSDNAKIIIVQLKDPVEINCTRPNNNTRKSINLGPGRAFYATGDIIGDIRQAHCNISRAKWNDTLREIAKKLAEQFNNRTIVFNQSSGGDPEIVMHSFNCAGEFFYCDTSQLFNSTWNSNSTWNDTNNNNSTEKIILSCRIRQIINRWQEVGKCMYAPPISGPIKCSSNITGLLLARDGGNETNVTETFRPAGGDMRDNWRSELYKYKVVQIEPLGIAPTKCKRRVVGRRRRRRAVGMLGAMFLGFLGAAGSTIGAASMTLTVQARQLLSGIVQQQNNLLRAPEAQQHMLQLTVWGIKQLQARVLAVERYLKDQQLLGIWGCSGKLICCTAVPWNTSWSNKSLNYIWDNMTWMEWEREIDNYTSLIYTLIEESQNQQEKNELELLELD

SEQ ID NO: 1406 - protein, 640 aa, Artificial Sequence
  Recombinant HIV protein
AENLWVTVYYGVPVWKEANTTLFCASDAKAYVTEVHNAWATRACVPTDPNPQEVALENVTENFNMWKNNMVEQMHEDIISLWDESLKPCVKLTPLCVTLKCINYNNTNNGSNANNTSIEGREEIKNCSFNITTTIRDKVQKEEALFYRLDLVPIDNDTYTLINCNTSVCTQACPKVSFEPIPIHFCTPAGFAILKCRDKKFNGTGSCKNVSTVQCTHGIRPVVSTQLLLNGSLAEEEVVIRSENFTDNVKTIIVQLNESVVINCTRPNNNTRKGIHIGPGRAFYTTGQIIGDIRQAHCNLSRAQWNKTLEQIVEKLGEQFRNKNISFMQHSGGDPEIVTHTFNCGGEFFYCNSTQLFNSTWTRPPNGTWRSNGTWNSTEGTNDTITLPCRIKQIINMWQGVGKCMYAPPISGQIRCTSNITGLLLTRDGGENRTDNGTEIFRPGGGNMRDNWRSELYKYKVVKIEPLGVAPTKCKRRVVGRRRRRRAVGTIGAMFLGFLGAAGSTMGAASITLTVQARLLLSGIVQQQNNLLRAPEAQQHMLQLTVWGIKQLQARVLALERYLSDQQLLGIWGCSGKLICCTTVPWNNSWSNKSYDNIWSNMTWMEWEREINNYTGEIYNLLEESQNQQEINEQELLALD

SEQ ID NO: 1407 - protein, 641 aa, Artificial Sequence
  Recombinant HIV protein
AENLWVTVYYGVPVWKEAKTTLFCASDAKAYEKEVHNVWATHACVPTDPNPQEMVLENVTENFNMWENDVVDQMHEDVISLWDQSLKPCVKLTPLCVTLNCSKAKNITEEVIKNNTYKEDIRNCSFNATTEVKDKKQKVHALFYRLDIVPLNKRNSSESEEENSSGYYRLINCNTSACTQACPKVTFDPIPIHYCTPAGYAILKCNEETFNGTGPCHNVSTVQCTHGIKPVVSTQLLLNGSLAEGEIIIRSKNLTDNAKTIIVHLNQSVEIVCTRPNENRRKSIRIGPGQAFYATGDIIGDIRQARCNISEEKWNETLQRVGRKLAEHFPNKTIKFKSSSGGDLEITTHSFNCRGEFFYCNTSGLFNGTYMPTYMPNSTNSNSSSNITIPCRIKQVINMWQEVGRCMYAPPIEGEITCKSNITGLLLVRDGGNGNDTNKTEIFRPEGGDMRDNWRSELYKYKVVEIKPLGIAPTECKRRVVGRRRRRRAVGIGAVILGFLGAAGSTMGAASITLTAQARQLLSGIVQQQSNLLKAPDAQQHLLQLTVWGIKQLQARVLAVERYLKDQQLLGIWGCSGKLICCTNVPWNSSWSNKSKEYIWNNMTWMQWDGEISNYTDIIYGLLEDSQIQQEKNEKDLLTLD

SEQ ID NO: 1408 - protein, 639 aa, Artificial Sequence
  Recombinant HIV protein
AENLWVTVYYGVPVWKEARTTLFCASDAKAYETEVHNVWATHACVPTDPNPQEMVLGNVTENFNMWKNDMVDQMHEDVISLWAQSLKPCVKLTPLCVTLECTQVNATQGNTTQVNVTQVNGDEMKNCSFNTTTEIRDKKQKAYALFYRLDLVPLERENRGDSNSASKYILINCNTSACTQACPKVNFDPIPIHYCTPAGYAILKCNNKTFNGTGSCNNVSTVQCTHGIKPVVSTQLLLNGSLAEEEIIIRSENLTDNVKTIIVHLDQSVEIVCTRPNNNTRKSIRIGPGQTFYATGDIIGNIREAHCNISEKKWHEMLRRVSEKLAEHFPNKTIKFTSSSGGDLEITTHSFNCRGEFFYCNTSGLFNSTYMPNGTYMPNGTNNSNSTIILPCRIKQIINMWQEVGRCMYAPPIAGNITCNSNITGLLLVRDGGKNNNTEIFRPGGGDMRDNWRSELYKYKVVEIKPLGVAPTRCKRRVVGRRRRRRAVGLGAVFLGFLGAAGSTMGAASITLTVQARQLLSGIVQQQSNLLQAPEAQQHLLQLTVWGIKQLQTRVLAIERYLKDQQLLGIWGCSGKLICCTAVPWNSSWSNKSLTDIWDNMTWMQWDREVSNYTGIIYRLLEDSQNQQERNEQDLLALD

SEQ ID NO: 1409 - protein, 653 aa, Artificial Sequence
  Recombinant HIV protein
AENLWVTVYYGVPVWREAKATLFCASDAKAYEREVHNVWATHACVPTDPDPQEMALVNVTENFNMWKNDMVDQMHEDIINLWDQSLKPCVKLTPLCVTLNCTDAKFNSTQSDNGTSTVNVSTSNEMKNCSFNITTEIRDKKKKESAIFYKLDVVPLDGNGNNSGNYSEYRLINCNTSTCTQACPKVSFDPIPIHYCAPAGYAILKCNNKTFNGSGPCNKVSTVQCTHGIKPVVSTQLLLNGSLAEEEIVIRSENITDNVKTIIVHLNESVEIECTRPGNNTRKSMRIGPGQIFYATGDIIGDIRQAYCNINESKWNETLQKVGKKLREHFSNKTIEFQPPSPGGDLEITTHSFNCGGEFFYCNTSRLFNGKFNGTMGNYTINSTITLPCRIKQIINMWQGVGRCMYAPPIAGNITCRSNITGILLTRDGSETNDGNTNETGTKTFKSNETETEIFRPGGGDMRDNWRSELYKYKVVEIKPLGIAPTKCKRRVVGRRRRRRAVGIGAMFLGILGAAGSTMGAASITLTVQARQLLSGIVQQQSNLLRAPEAQQHMLQLTVWGIKQLQTRVLAIERYLKDQQLLGIWGCSGKLICCTAVPWNTSWSNRSQQDIWDNMTWMQWDREVSNYTNIIYRLLEESQNQQEKNEKDLLALD

SEQ ID NO: 1410 - protein, 628 aa, Artificial Sequence
  Recombinant HIV protein
AENLWVTVYYGVPVWKEAKTTLFCASDAKAHEREVHNVWATYACVPTDPNPQEIVLKNVTENFNMWENDMVDQMQEDVISLWDQSLKPCIKLTPLCVTLECTNVNIINGTIHNETYESMKNCSFNTTTELKDKKQSVYALFYRLDIVPLNNSNEYYRLINCNTSACKQACPKVTFDPIPIHYCAPAGYAILKCNDKTFSGTGPCHNVSTVQCTHGIKPVVSTQLLLNGSLAEGEIIIRSKKLDDNANTIIVHLDEPVKIECTRPNNNTRKSIRIGPGQTFYATGEIIGNIRQAHCDISEDQWNETLQRVGKKLAELFPNKTITFNSSSGGDLEITTHSFNCRGEFFYCNTSSLFKGTYRPNGTSNSTSGSIITLPCYIKQVINLWQEVGRCIYAPPIEGNITCISNITGLLLVRDGGNHEEANTTETFRPGGGNMRDNWRSELYKYKVVEIKPLGVAPTKCRRRVVGRRRRRRAVGVGAVMFLGFLGAAGSTMGAASITLTVQARQLLSGIVQQQSNLLKAPEAQQHLLQLTVWGIKQLQTRVLAIERYLKDQQLLGIWGCSGKLICCTSVPWNSSWSNNRSQDDIWENMTWMQWDREISNYTNTIYRLLEDSQNQQENNEKDLLALD

SEQ ID NO: 1411 - protein, 642 aa, Artificial Sequence
  Recombinant HIV protein
AENLWVTVYYGVPVWKDAETTLFCASDAKAYDKEVHNVWATHACVPTDPNPQEVFLENVTEEFNMWKNNMVEQMHTDIISLWDQSLQPCVQLTPLCVTLNCTDYKGNYTNYNYTKNNGTGHNITSDMEGEIKDCSFNVTTELRDKRQKVHSLFYRLDIVQINSSQTNSSEYRLINCNTSACTQACPKISFNPIPIHYCAPAGFAILKCNDKKFHGTGPCKNVSSVQCTHGIKPIVSTQLLLNGSLAEEKVAIRSENITNNAKNILVQLKSPVNITCVRPNNNTRTSVRIGPGQTFYATGAITGDIRQAHCNVSKAKWNETLRQVAVQLKTYFNKTIIFNSSAGGDLEITTHSFNCGGEFFYCNTSGLFNSTWNDTSNHNTSGTESNANITLQCRIKQIINMWQRAGQCIYAPPIQGIIKCESNITGLILTRDGGDNNNTTTETFRPGGGDMRDNWRSELYKYKVVKIEPLGVAPTKCRRRVVGRRRRRRAVGMAALFFGFLGAAGSTMGAASITLTVQARQLLSGIVQQQSNLLRAPEAQQHMLRLTVWGIKQLQARVLAVERYLRDQQLLGIWGCSGKLICCTNVPWNSSWSNKSQNEIWENMTWLQWEKEISNYTDEIYNLLEKSQNQQEKNEQDLLALD

SEQ ID NO: 1412 - protein, 626 aa, Artificial Sequence
  Recombinant HIV protein
AENLWVTVYYGVPVWKDAETTLFCATDAKAYKTEMHNVWATHACVPTDPNPQEIMMENVTEDFNMWKNNMVEQMHTDIISLWDQSLKPCVKLTPLCVTLNCGKVKNDTRDELRNCSYNMTTELRDRRQKVFSLFYRLDIVEIENNRTNNRTNNTEYRLINCNTSACTQACPKVTFEPIPIHYCAPAGYAILKCNNESFNGTGPCKNVSTVQCTHGIKPVVSTQLLLNGSLAKDQVMIRSENITNNAKNIIVQFKGSVQINCTRPNNNTRKSVHIGPGQAFYATDIIGDIRQAHCNVSGTEWNKTLGEVVKQLRTYWNRTIIFTNSSGGDLEITTHSFNCAGEFFYCNTSGLFNSTWYTNGSTQGVTNDTIQLQCRIKQIINMWQRVGQCIYAPPIPGVINCSSSITGMILTRDGGNNNNGANGNETFRPGGGDMRDNWRSELYKYKVVRIEPLGVAPTKCRRRVVGRRRRRRAVGMGAVFLGFLGAAGSTMGAASITLTVQARQLLSGIVQQQSNLLRAPEAQQHLLKLTVWGIKQLQARVLAVERYLRDQQLLGIWGCSGKLICCTNVPWNSSWSNNKTQSEIWDNMTWLQWDKEISNYTELIYKLIEESQIQQEKNEQDLLALD

SEQ ID NO: 1413 - protein, 648 aa, Artificial Sequence
  Recombinant HIV protein
AENLWVTVYYGVPVWKDAETTLFCASDAKAYDKEKHNVWATHACVPTDPNPQEIHLENVTEEFNMWKNNMVEQMHTDIISLWDQSLKPCVKLTPLCVTLNCSHNITRLNTSSPNITGNDTNSSPNITENDTENERKNCSFNITTELRDKSKQVYSLFYRLDIVPIDGSDNSSDNSNNYRLINCNTSACTQACPKVSFEPIPIHYCAPAGFAILKCKDGNFSGKGPCKNVSTVQCTHGIKPVVSTQLLLNGSLAEEKVKIRSENISDNTKNIIVQLVQPVKINCTRPDNNTRKSIHIGPGQAFFATGAIIGKIRQAHCNVSKTEWNKALKQVVEQLRRDFGNKTIIFKNSSGGDLEITTHSFNCGGEFFYCNTSGLFNSTWLSNSTNSTDNTGTNDTITLQCRIKQIINMWQRVGQCMYAPPIPGVIRCESNITGLMLTRDGGNNATNETFRPGGGDMRDNWRSELYKYKVVKIEPLGVAPTKCKRRVVGRRRRRRAVGIGAVFLGFLGAAGSTMGAASITLTVQARQLLSGIVQQQGNLLRAPEAQQHLLKLTVWGIKQLQARVLAVERYLRDQQLLGIWGCSGKLICCTTVPWNSSWSNKSYDDIWENMTWQQWEREISNYTDIIYRLIEDSQNQQEMNEKDLLALD

SEQ ID NO: 1414 - protein, 640 aa, Artificial Sequence
  Recombinant HIV protein
AENLWVTVYYGVPVWKEATTTLFCASDAKSYETEAHNVWATHACVPTDPNPQEIPLVNVTENFNMWKNNMVEQMQTDIISLWDQSLQPCVKLTPLCVTLNCSDIDNNRNNSTVTNSTVTNSTADMKNCSFRVPTAIRDRKQKVYSLFYRLDIVQIDKKKNDSNNSNITQYRLINCNTSACTQACPKISFEPIPIHYCAPAGFAILKCRDKEFNGTGPCKNVSTVQCTHGIRPVVSTQLLLNGSLAEGKIMIRSENITNNGKNIIVQFNETVKINCTRLNNNTRKSISIGPGQAFYATGDIIGDIRQAHCNVSRAEWNETLRKVAEELRTYFKNKTIHFNKSAGGDLEVTTHSFNCGGEFFYCNTSKLFDSSWPKTNSTVQESNSTDNITLQCRIKQIINMWQRVGQCMYAPPIAGVIRCESNITGLILTRDGGSNTNASETFRPGGGDMRDNWRSELYKYKVVKIEPLGVAPTRCKRRVVGRRRRRRAVGIGAVFIGFLGAAGSTMGAASITLTVQTRQLLAGIVQQQSNLLRAPEAQQHLLKLTVWGIKQLQARVLAVERYLKDQQLLGIWGCSGKLICCTTVPWNDSWSNKSLDEIWNNMTWLQWDKEINNYTQIIYGLIDKAQNQQEKNEQELLALD

SEQ ID NO: 1415 - protein, 622 aa, Artificial Sequence
  Recombinant HIV protein
AENLWVTVYYGVPVWKEAKTTLFCASDAKAYETEVHNIWATHACVPTDPNPQEMELPNVTENFNMWKNDMVDQMHEDIISLWDQSLKPCVKLTPLCVTLNCTITNSSSIMTNCTFNTTTELKDKKRKASASFYRLDIVPLNGDSNGSSSGSYRLINCNTSTCTQACPKVSFDPIPIHYCAPAGYAILKCNDETFNGTGPCHNVSTVQCTHGIKPVVSTQLLLNGSLSEGEIIIRSENLTDNVKTIIVHLNKSIEINCIRTGNNTRRSIRIGPGQTFYATGDIIGDIRKAYCNISKHIWNKTLEEVATKLGAHFINKTIKFAPPSGGDLEITTHSFNCRGEFFYCNTTQLFNNISIGRFNTSIENDTNIILPCRIKQIINMWQEVGRCMYAPPIEGNITCRSNITGILLTRDGGNGGADNSTETFRPGGGNMKDNWRSELYKYKVVEIKPLGIAPTRCKRRVVGRRRRRRAVGIGAVFLGFLGAAGSTMGAASITLTVQARQLLSGIAQQQSNLLRAPEAQQHMLQLTVWGIKQLQARVLAIERYLQDQQLLGIWGCSGKLICCTTVPWNSTWSNKSLDNIWDNMTWMQWDKEISNYTKTIYTLLENASIQQEQNEKDLLELD

SEQ ID NO: 1416 - protein, 634 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVEIKPLGIAPTACKRRVVGRRRRRRAVGLGAVIFGFLGAAGSTMGAASITLTVQARQLLSGIVQQQSNLLKAPEAQQHLLQLTVWGIKQLQTRVLAIERYLKDQQLLGIWGCSGKLICCTAVPWNSSWSNKSHDEIWGNMTWMQWDREISNYTNTIYRLLEDSQNQQEQNEKDLLALD

SEQ ID NO: 1417 - protein, 647 aa, Artificial Sequence
  Recombinant HIV protein
AENLWVTVYYGVPVWREAKTTLFCASDAKAYEKEVHNVWATHACVPTDPNPQEIDLNVTENFNMWKNDMVEQMHEDVISLWDQSLKPCVKLTPICVTLECTDANITCNSTTSSNNCTSYEINKEDMGEIKNCSFNTTTELIDKQKKVHALFYRLDIVSLEKDNSSKKNDSNEYYRLINCNTSACTQACPKVTFDPIPIHYCAPAGYAILKCKNKTFNGTGPCNNVSTVQCTHGIKPVVSTQLLLNGSLAEEEIIIRSENLTNNAKIIIVHLNQAVEIVCTRPGNNTRKSIRIGPGQTFYATGDIIGDIRQAHCNISEAKWNKTLREVSKKLAEHFPNKTIIFNSSSGGDLEITTHSFNCGGEFFYCNTSSLFNSTFNSTYMTNDTDMNSNSTISIPCRIKQIINMWQEVGRCMYAPPIAGNITCKSNITGLLLVRDGGNSNDTNEPEIFRPQGGDMRDNWRSELYKYKVVEIKPLGVAPTACKRRVVGRRRRRRAVGLGAMILGFLGAAGSTMGAASITLTVQARQLLSGIVQQQSNLLRAPEAQQHMLQLTVWGIKQLQTRVLAIERYLKDQQLLGIWGCSGKLICCTAVPWNSSWSNKSQDQIWNDTTWMQWDKEISNYTDIIYTLLEKSQNQQEINEKDLLALD

SEQ ID NO: 1418 - protein, 626 aa, Artificial Sequence
  Recombinant HIV protein
AENLWVTVYYGVPVWKEAKTTLFCASDAKAYETEVHNVWATHACVPTDPNPQELVLENVTENFNMWRNDMVDQMHEDVISLWDQSLKPCVKLTPLCVTLECRNATSKMVNDTRNVEEMKNCSFNTTTELRDRKQTVYASFYKLDIVPLNENKSTSSENYRLINCNTSACTQACPKVNFDPIPIHYCTPAGYAILKCNNKTFNGTGPCSNVSTVQCTHGIKPVVSTQLLLNGSLAEEGIIIRSENLTDNVKTIIVHLEEPVEIVCTRPNNNTRKSVRIGPGQTFYATGEIIGDIRQAHCNISEAKWNETLQNVTKKLKEHFPNKTIIFNSSSGGDLEITTHSFNCRGEFFYCNTSKLFNGIYNGTQSNSSNSNSTIIIPCKIKQIVNMWQKVGRCMYAPPIAGNITCTSNITGLLLVRDGGPDNVTEIFRPGGGDMRDNWRSELYKYKVVEIKPLGIAPTGCKRRVVGRRRRRRAVGLGAVFLGFLGAAGSTMGAASITLTVQARQLLSGIVQQQSNLLRAPEAQQHMLQLTVWGIKQLQTRVLAIERYLKDQQLLGIWGCSGKLICCTAVPWNASWSNRSHDDIWNNMTWMQWDREISNYTNTIYRLLEESQNQQERNEKDLLALD

SEQ ID NO: 1419 - protein, 639 aa, Artificial Sequence
  Recombinant HIV protein
AENLWVTVYYGVPVWKEASTTLFCASDAKAYEAEAHNIWATHACVPTDPNPQEIEIKNVTENFNMWKNDMVEQMHEDIISLWDQSLQPCVKLTPLCVTLNCSDLDNSNKGNATNTTVASEAGMNTTVAPEAGMKNCSFNITTEVKDKKKLVYAHFYNLDVVQLDGNTNSYRLIHCNTSACTRACPKITFEPIPIHYCAPAGFAILRCNNKMFNGTGPCNNVSTVQCTHGIKPVVSTQLLLNGSLAEEGVIIRSENLTDNTKTIIVQLNESVIINCTRPNNNTRQGVHIGPGQALFTNRVIGNIRLAYCNISRKDWNKTLRQVAEKLGNLYNKTKIIFEPSSGGDPEIVTHSFNCGGEFFYCSTSKLFNETIDLNNTYNASIENNTIITLPCRIKQIINMWQGVGKCIYAPPIEGLIKCTSNITGILLTRDGGRDNSSSNETFRPGGGDMRDNWRSELYKYKVVKIEPIGLAPTKCKRRVVGRRRRRRAIGLGAMFLGFLGAAGSTMGAASVTLTVQARQLLSGIVQQQNNLLRAPEAQQHLLQLTVWGIKQLQARVLAVERYLKDQQLLGIWGCSGKLICCTTVPWNTSWSNRTQEIWDNLTWMEWEREIDNYTGLIYSLIEESQIQQEQNEKDLLELD

SEQ ID NO: 1420 - protein, 624 aa, Artificial Sequence
  Recombinant HIV protein
AENLWVTVYYGVPVWKDAVTTLFCASDAKAYDTEVHNVWATHACVPTDPNPQEKQLENVTEDFNMWKNDMVDQMHADIISLWDQSLKPCVQLTPLCVTLHCRNTNASSNTSGDMQGEEMKNCSFNVTAELRDKRKNEYALFYRQDVVQINETDNSTYRLINCNTSTCTQACPKVTFEPIPIHYCAPAGYAILKCNEKGYKGIGKCRNVSTVQCTHGIKPVVSTQLLLNGSLAEGEVVIRTENITNNAGTIIVQLNETVKINCSRPNNNTRRSVRIGPGQTFYATDIIGDIRQAHCNVSSTKWNRTLHQVATQLKKHFNTTTITFAEPSGGDLEIITHSFNCGGEFFYCNTSRLFNSTWGSNNTWDNSTEQNITLRCKIKQIINMWQRVGQCMYAPPIRGEIRCESNITGLLLTRDGGGNSSSANETFRPTGGNMKDNWRSELYKYKVVKIEPLGVAPTRCKRRVVGRRRRRRAALGAVFLGFLGAAGSTMGAASITLTVQARQLLSGIVQQQSNLLKAPEAQQHLLKLTVWGIKQLQARVLALERYLKDQQLLGIWGCSGKLICCTNVPWNSSWSNKTYEYIWDNMTWLQWDKEISNYTELIYGLLEESQNQQEKNEQDLLALD

SEQ ID NO: 1421 - protein, 635 aa, Artificial Sequence
  Recombinant HIV protein
AENLWVTVYYGVPVWRDADTTLFCASDAKAYEKEVHNVWATHACVPTDPNPQEIHLKNVTEEFNMWKNNMVEQMHEDIISLWDQSLKPCVKLTPLCVTLDCIEIRNNTDNITVDSNMKGEITNCSFNMTTELRDKKQKVSAFFYRQDVVPVNSNQDNSSYRLINCNTSACTQACPKVTFEPIPIHYCAPAGFAILKCNDKKFNGTGPCKNVSTVQCTHGIKPVVSTQLLLNGSLAEEEVAIRSENISNNGKTIIVQLVKPVNITCIRPNNNTRKSVRIGPGQTFYATGEIIGNIRQAHCVVNKTEWNETLYQVVTRLREYFKNTTITFTNHSGGDLEVTTHSFNCGGEFFYCNTSELFNSNWTNTNNNTNNASSEANGNITLTCKIKQIINMWQRVGQCMYAPPIQGIIRCESNITGLLLTRDGGFRNDTNETYEAFRPGGGDMRDNWRSELYKYKVVKIEPLGVAPTHCKRRAVGRRRRRRAVGLGAVFLGFLGAAGSTMGAASMTLTVQARQLLSGIVQQQSNLLRAPEAQQHLLRLTVWGIKQLQARVLALERYLRDQQLLGIWGCSGKLICCTAVPWNSSWSNKTYDDIWGNMTWLQWDKEISNYTQIIYSLIEESQNQQEKNEKDLLALD

SEQ ID NO: 1422 - protein, 621 aa, Artificial Sequence
  Recombinant HIV protein
AENLWVTVYYGVPVWKEATTTLFCASDAKAYKAEAHNIWATHACVPTDPNPQEIELKNVTENFNMWRNNMVEQMHEDIISLWDQSLKPCVKLTPLCVTLNCTNVTSSTNGTVGNTEDMKNCSFNITTIVRDKKKQEYALFYRLDIVEINPNDTSYRLINCNTSACTQACPKMSFEPIPIHYCAPAGFAILKCNDKKFKGTGPCSNVSTVQCTHGIRPVVSTQLLLNGSLAEEEIMIRSEDFTNNVKNIIVQFNKSVEIVCIRPGNNTKRSIHFGPGQALYAYSIIGDIRNANCTINKTSWHDTLQKVEKELEKIYNKKINFEPSSGGDLEITTHSFNCGGEFFYCNTSKLFNSTWANSTWDNSNITNITIPCRIKQIINMWQGVGRCMYAPPIAGEIRCTSNITGLLLTRDGGSNNTNETETFRPGGGNMKDNWRSELYKYKVVRIEPLGVAPTRCKRRVVGRRRRRRAIGLGALFLGFLGAAGSTMGAASVTLTVQARELLSGIVQQQNNLLRAPEAQQHLLQLTVWGIKQLQARVLAVERYLKDQQLLGIWGCSGKHICCTTVPWNSSWSNKSLDDIWQNMTWMQWEKEIENYTGVIYNLIEDSQIQQEKNEKELLELD

SEQ ID NO: 1423 - protein, 629 aa, Artificial Sequence
  Recombinant HIV protein
AENLWVTVYYGVPVWKEATTTLFCASDAKAYDKEVHNVWATHACVPTDPNPQEMVLGNVTENFNMWKNEMVNQMHEDVISLWDQSLKPCVKLTPLCVTLECSNVTYNESMKEVKNCSFNLTTELRDKKQKVHALFYRLDIVPLNDTEKKNSSRPYRLINCNTSACTQACPKVTFDPIPIHYCTPAGYAILKCNDKKFNGTGPCHKVSTVQCTHGIKPVVSTQLLLNGSLAEGEIIIRSENLTNNAKTIIVHLNQSVEIVCARPSNNTRTSIRIGPGQTFYATGAITGDIRQAHCNISKDKWNETLQRVGEKLAEHFPNKTIKFNSSSGGDLEITTHSFNCRGEFFYCNTSGLFNGTFNGTYVSPNSTDSNSSSIITIPCRIKQIINMWQEVGRCMYAPPIAGNITCKSNITGLLLVRDGGTGSESNKTEIFRPGGGDMRDNWRSELYKYKVVEIKPLGVAPTKCKRRVVGRRRRRRAVGIGAVFLGFLGAAGSTMGAASITLTVQARQLLSGIVQQQSNLLRAPEAQQHLLQLTVWGIKQLQTRVLAIERYLKDQQLLGIWGCSGKLICCTAVPWNYSWSNRSQDDIWDNMTWMQWDKEISNYTNTIYKLLEDSQIQQEKNEKDLLALD

SEQ ID NO: 1424 - protein, 636 aa, Artificial Sequence
  Recombinant HIV protein
AENLWVTVYYGVPVWKEAKTTLFCASDAKGYDKEVHNVWATHACVPTDPNPQEMPLENVTENFNMWENDMVNQMHEDVISLWDESLKPCVKLTPLCVTLNCTDVNKNVSSSDTDNYKETMKERKNCTFNMTTELRDKNQKKYALFYKLDIVPLDDNDNASYRLINCNTSTCTQACPKVSFDPIPIHYCAPAGYAILKCKNKTFNGIGPCNKVSTVQCTHGIKPVVSTQLLLNGSLAEEDIVIRSENITDNAKTIIVHLNESVEIVCIRPNNNTRKSIRIGPGQTFYATGDIVGDIRQAYCNISEGKWNKTLQRVSEKLAEHFPNSTINFNSSSGGDLEITTHSFNCGGEFFYCNTSGLFNGTYMNNDTKSNDTKSNSSSIITIPCRIKQIINMWQEVGRCVYAPPIAGNITCKSNITGILLTRDGGRGEEVKNDTETFRPGGGNMKDNWRSELYKYKVVEIKPLGVAPTACKRRVVGRRRRRRAVGLGAVLLGFLGAAGSTMGAASITLTVQARQLLSGIVQQQSNLLRAPEAQQHMLQLTVWGIKQLQARVLAIERYLKDQQLLGIWGCSGKLICCTAVPWNSSWSNKNQTEIWDKMTWMQWDREISNYTDTIYRLLEDSQNQQEKNEKDLLELD

SEQ ID NO: 1425 - protein, 630 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVEIKPLGVAPTACKRRVVGRRRRRRAVGLGAVFLGFLGAAGSTMGAASITLTVQARQLLSGIVQQQSNLLRAPEAQQHMLQLTVWGIKQLQTRVLAIERYLKDQQLLGIWGCSGKLICCTAVPWNTSWSNRSQADIWGNMTWMQWDREISNYTNTIFRLLEDSQIQQESNEKDLLALD

SEQ ID NO: 1426 - protein, 620 aa, Artificial Sequence
  Recombinant HIV protein
AENLWVTVYYGVPVWKEAKTTLFCASDAKAYEKEVHNVWATHACVPTDPNPQEIVLGNVTEDFNMWKNDMVDQMHEDVISLWDQSLKPCVKLTPLCVTLDCANVTSNITNGEEIKNCSFNATTDVRDKKKTVYSLFYRLDIVQLDGRSNTSNYRLINCNTSTCTQACPKVSFDPIPIHYCAPAGYAILKCNNKTFNGKGPCHNISTVQCTHGIKPVVSTQLLLNGSLAEEEIIIRSENLTNNVKTIIVHLNKPVKIVCTRPGNNTRKSIRIGPGQTFYATGEIIGNIRQAHCNISKEEWNKTLQGVGEKLAEHFPNKTIEFTSPSGGDLEITTHSFNCRGEFFYCNTSDLFNGIYNGTYIPKGNLNSTITIQCKIKQFINMWQEVGRCMYAPPIQGNITCESNITGLLLVRDGGNSNSTEEIFRPGGGDMRDNWRSELYKYKVVEIKPLGVAPTDCKRRVVGRRRRRRAALGAVFLGFLGAAGSTMGAASITLTVQARQLLSGIVQQQSNLLRAPEAQQHLLQLTVWGIKQLQTRVLAIERYLKDQQLLGIWGCSGKLICCTAVPWNISWSNKSYHEIWDNMTWMQWDKEISNYTDQIYRLLEVSQNQQESNEKDLLALN

SEQ ID NO: 1427 - protein, 650 aa, Artificial Sequence
  Recombinant HIV protein
AENLWVTVYYGVPVWREAETTLFCASDAKAVSPEAHNIWATHACVPTDPNPQEMQLENVTEEFNIWNNSMVEQMHKDIIDLWDQSLKPCVQLTPLCVTLNCSSVSNSSSSNSTYNITVSQSMEGEIKNCSFNMTTELRDKKKKVYALFYRLDVIEINDTSSSNSDNSSSTQYNKYRLINCNTSACTQACPKVSFEPIPLHLCAPAGFAILKCNDKKFNGKGTCNNVSTVQCTHGIKPVVSTQMLLNGSLAGEEIGIRSENISNNAKTIMIQLKEPVQINCTRPNNNTRKSIHMGPGQAFYATDAVIGDIRQAYCNVSKGTWNKTLQAVAKQLYKHFNKTIIFNSSSGGDLEITTHSFNCGGEFFYCNTSRLFNSTWNNSSIWDNSTGDYNSTKDNETITLPCRIKQIINMWQKVGQCMYAPPIKGIIRCDSNITGLLLTRDGGINNSTSETFRPGGGDMRDNWRSELYKYKVVQIEPIGLAPTHCKRRVVGRRRRRRAVGLGALFLGFLGAAGSTMGAASMTLTVQARQLLSGIVQQQSNLLRAPEAQQHLLKLTVWGVKQLQARVLALERYLRDQQLLGIWGCSGKLICCTTVPWNSSWSNRTLSEIWDNMTWLQWDKEVSQYTEEIYKLIAESQNQQEKNEQELLALD

SEQ ID NO: 1428 - protein, 628 aa, Artificial Sequence
  Recombinant HIV protein
AENLWVTVYYGVPVWRDAETTLFCASDAKAYDTEAHNVWATHACVPTDPSPQEIPLINVTENFNMWKNKMVEQMQEDVISLWDQSLKPCVKLTPLCVTLNCTKATHTGDNSTSVNLTEIVEMQNCSYNMTTELRDRSRKEYSLFYKLDIVLVNESNSNSSQYRLINCDTSTCTQACPKVSFEPIPIHYCAPAGFAILKCRDKQFNGTGPCSNVSTVQCTHGIKPVVSTQLLLNGSLAEGEVAIRSENFTNNAKTIIVQLTKPVKINCIRPGNNTRRSHRIGPGQTFFATGAIIGDIRQAHCNVSTTEWNNTLSQVVKQLKRYFNNKTIIFTNHSGGDLEITTHTFNCGGEFFYCNTSGLFNSTWWNNNNSSNNITTLQCRIKQIVNLWQRVGKCMYNPPIQGVIRCESNITGLLLTRDGGLNDSSTNETFRPGGGDMRDNWRSELYRYKVVKIEPLGVAPSRCRRRVVGRRRRRRAIGMGAVFLGFLGAAGSTMGAASITLTVQARQLLSGIVRQQSNLLKAPEAQQHLLKLTVWGIKQLQARVLALERYLRDQQLLGIWGCSGKLICCTNVPWNSSWSNKTYNDIWEGMTWLQWDKEISNYTETIYNLIEQSQNQQEKNEQELLALD

SEQ ID NO: 1429 - protein, 632 aa, Artificial Sequence
  Recombinant HIV protein
AENLWVTVYYGVPVWREADTTLFCASDAKAYSTEVHNVWATHACVPTDPDPQEILLKNVTEDFNMWKNNMVEQMHADIINLWDQSLKPCVKLTPLCVTMQCTDMTNISIKLASIANTSIAEETQGEIKNCSFNVTELRNKRKKEYAFFYKQDIVQINNNESMLISCNTSTCTQACPKVSFEPIPIHFCAPAGFAILKCNDKKFNGTGPCENVSTVQCTHGIKPVVSTQLLLNGSLAEEEVVIRSENITNNAKTIIVQLDKPVNITCVRPNNNTIKSVRIGPGQAFYTAGQVIGDIRKAYCEVNRTEWKSALNQVASKLRENFQNASTIKFNEHSGGDIEITTHMFNCKGEFFYCNTSSLFNYTFSNSTEDNNPSNATITLQCRIRQVVNMWQRVGLCMYAPPIKGKLRCESNITGLLLTRDGGNNNNNATETFRPGGGDMRDNWRSELYKYKVVQIEPLGVAPTYCKRRVVGRRRRRRAVVGLGAVFLGFLGAAGSTMGAASITLTVQARQLLSGIVQQQSNLLRAPEAQQQLLKLTVWGIKQLQARVLALERYLRDQQLLGLWGCSGKLICCTTVPWNSSWSNKTYNSIWDNMTWMQWDREINNYTEIIYNLIEESQNQQEQNEKDLLALD

SEQ ID NO: 1430 - protein, 627 aa, Artificial Sequence
  Recombinant HIV protein
AENLWVTVYYGVPVWKEAKTTLFCASDAKSYRTEAHNIWATHACVPTDPNPQELELENVTENFNMWKNDMVNQMHEDIISLWDQSLKPCVKLTPLCVTLNCQEMNSSTKTNSSISNEDKRMNCSFNVTTVVRDRKKQVAALFYRLDLVAVDNDNSTNYRLINCNTSACTQACPKVSFEPIPIHYCAPAGFAILKCRDKQFNGTGPCTNVSTVQCTHGIRPVVSTQLLLNGSLAEEEIMIRSENISNNAYNIIVQLNESVAIDCTRPYNNTRQSIHIGPGQAVYATDARKIVGDIRQAYCTIDGTEWKKMLQRVAEKLGSLINKPTIKFKPSAGGDAEITTHSFNCGGEFFYCNTSNLFNYTWNNSTGLGNITRNITLPCRIKQIINMWQGVGKCMYAPPIEGQIKCSSNITGLILTRDGGNTSDDHETFRPGGGNMKDNWRSELYKYKVVRIEPIGLAPTKCKRRVVGRRRRRRAIGLGAMFLGFLGAAGSTMGSASVALTVQARQLLSGIVQQQNNLLRAPEAQQHLLQLTVWGIKQLQARVLAVERYLKDQQLLGLWGCSGKHICCTNVPWNSSWSNRSLDNIWHNMTWMEWEREIDNYTGLIYSLIENSQIQQEKNEQELLELD

SEQ ID NO: 1431 - protein, 635 aa, Artificial Sequence
  Recombinant HIV protein
AENLWVTIYYGVPVWKEAKTTLFCASDAKAYSKEVHNVWATHACVPTDPDPQELFLENVTENFNMWKNDMVDQMHEDVISLWDQSLKPCVKLTPICVTLQCVDATIYNGTIKDSSTNYTLNSTEELKNCSFNMTTELRDKTRKVYALFYRLDVEPLNNDNNSTKYRLINCNTSACTQACPKVSFDPIPIHYCAPAGYAILKCNNETFNGTGPCNKVSTVQCTHGIRPVISTQLLLNGSLAEKDIIIRSENLTDNAKTIIVQLNESVEIVCERPNNNTRKSIRIGPGQTFYATGDIIGDIRQAHCNISEKAWNNTLHRVSEKLKEHFPNRTIQFNSSSGGDLEITMHSFNCRGEFFYCNTSILFNSTYNTNGTYWHKGRNDSNITLPCKIKQFINMWQEVGRCMYAPPIAGKITCVSNITGLLLTRDGGKGNNETETFRPGGGDMRDNWRSELYKYKVVEIKPLGIAPTKCQRRVVGRRRRRRAVGLGAVFLGFLGAAGSTMGAASITLTVQARQLLSGIVQQQSNLLRAPEAQQHMLQLTVWGIKQLQARVLAIERYLKDQQLLGIWGCSGKLICCTNVPWNSSWSNKSEKDIWNNLTWMQWDREIDNYTNIIYELLEESQKQQENNEKELLALD

SEQ ID NO: 1432 - protein, 622 aa, Artificial Sequence
  Recombinant HIV protein
AENLWVTVYYGVPVWREAKATLFCASDAKAYDTEVHNVWATHACVPTDPNPQEIILENVTENFNMWKNNMVEQMHEDIISLWDQSLKPCVKLTPLCVTLNCTDVTVNGTIVKVNSTGMKNCSFNITTEIRDKKKKESALFYRLDIVPLDESSDSSSNYSEYRLISCNTSTCTQACPKVTFDPIPIHYCAPAGYAILKCNNKTFNGLGPCNNVSTVQCTHGIKPVVSTQLLLNGSLAEEEIIIRSENLTDNVKTIIVHLNDSVPITCTRPNNNTRKSMRIGPGQTFYATGEIIGDIRQAHCNITRNKWNETLERIKRKLREHFPNKTIEFKPSSGGDPEITTHSFNCNGEFFYCNTSGLFNAEEANITDITLPCRIRQIINMWQGVGRCIYAPPIAGNITCTSDITGLLLTRDGGSDGNSTKETFRPGGGDMRDNWRSELYKYKVVEIKPLGVAPTKCKRRVVGRRRRRRAVGIGAVFFGFLGAAGSTMGAASITLTVQARQLLSGIVQQQSNLLRAPEAQQHMLQLTVWGIKQLQTRVLAIERYLKDQQLLGIWGCSGKLICCTTVPWNSSWSNKTQNDIWDNMTWMQWDREINNYTNTIYRLLEESQNQQEKNEQDLLALD

SEQ ID NO: 1433 - protein, 628 aa, Artificial Sequence
  Recombinant HIV protein
AENLWVTVYYGVPVWKETTTTLFCASDAKSYKEEAHNVWATHACVPTDPNPQEIFLGNVTENFNMWKNDMVDQMHEDIISLWDQSLKPCVKLTPLCVTLNCTNINATISNATMGEMKNCSFNITTELRDKKKQEYALFYKLDVVQIDDGANGTNPKYRLINCNTSACTQACPKVTFEPIPIHYCAPAGFAILKCNDKKFNGMGPCNNVSTVQCTHGIKPVVSTQLLLNGSLAEEEVIIRSENLTNNVKNIIVQLNESVTLTCVRPNNNTRKSIRIGPGQTFYATNIIGDIRQAHCNINGTNWTKTLQRVANKLIDLLNLTQINFEPALGGDPEITTHTFNCGGEFFYCNTTNLFNATKWFNRSIEESANANDTSENSTLTLPCRIKQIINMWQGVGKCMYAPPIAGQIKCSSNITGLLLTRDGNNSHETFRPGGGDMGDNWRSELYKYKVVKIEPIGLAPTRCKRRVVGRRRRRRAIGLGAVFLGFLGAAGSTMGAASLTLTVQARQVLSGIVQQQNNLLRAPEAQQHLLQLTVWGIKQLQARVLAVERYLKDQQLLGIWGCSGKHICCTAVPWNSSWSNKSVDDIWGNMTWMQWEKEIDNYTGLIYSLIEESQLQQEKNEQELLEWD

SEQ ID NO: 1434 - protein, 617 aa, Artificial Sequence
  Recombinant HIV protein
AENLWVTVYYGVPVWKEATTTLFCASDAKAYIKEAHNIWATHACVPTDPNPQEIALENVTEKFNMWKNGMVDQMHEDIISLWDESLKPCVKLTPLCVTLNCTNATNDKVSSELEMKNCSFYITTEIRDRRKQEYALFYRSDVVQINGNNISYRLINCNTSACKQACPKVNFEPIPIHYCAPAGYAILKCNGENFNGTGLCENVSTVQCTHGIRPVVSTQLLLNGSLAEKEIVIRSENITNNAKTIIVQLNETVIINCTRPSNNTRKSIRIGPGQTFYATGDITGDIRQAHCNISATKWINTLQQVANKLRDHFNKTIEFQPSSGGDPEITEHTFNCGGEFFYCNTTNLFNWTFNSISNNINTSTNEITIQCRIKQIINRWQGVGKCMYAPPTAGSINCLSNITGLLLTRDGGNTSEEIFRPGGGDMRDNWRSELYKYKVVRLEPLGLAPTKCRRRVVGRRRRRRAIGLGAMFLGFLGAAGSTMGAASMTLTVQARQLLSGIVQQQDNLLRAPEAQQHMLQLTVWGIKQLQARVLAVESYLKDQQLLGIWGCSGKHICCTNVPWNSSWSNRSLKTIWENMTWMQWEREIENYTDLIYSLIEESQTQQEQNEQELLQLD

SEQ ID NO: 1435 - protein, 630 aa, Artificial Sequence
  Recombinant HIV protein
AENLWVTVYYGVPVWRDAETTLFCASDAKGYETEKHNVWATHACVPTDPNPQEIHLENVTEEFNMWKNNMVDQMHTDIISLWDQSLKPCVKLTPLCVTLQCSDVTSNGTNSNVTNREEMKNCSFNVTTEIRDKKQKVYSLFYRLDIVQISNSSNSSEYILINCNTSTCTQACPKISFEPIPIHYCAPAGFAILKCKDEEFDGTGPCKNVSTVQCTHGIKPVVSTQLLLNGSLAEKGVKVRSENITNNAKNIIIQLSKPVEINCIRPNNNTRKSIRIGPGQSFYATGDIIEDIREAHCNVSQTEWNNTLHQVAEQLQKYFNNKTIIFNGSSGGDLEITTHSFNCGGEFFYCNTSGLFNSSWNINGNRESNKTQSNGTITLPCRIKQIINMWQRAGQCIYAPPIQGAIKCVSNITGLILTRDGGNNNNSSNETFRPGGGDMRDNWRSELYKYKVVKIEPLGVAPTRCKRRVVGRRRRRRAVGIGAVFLGFLGAAGSTMGAASITLTVQARQLLSGIVQQQSNLLRAPEAQQQLLKLTVWGIKQLQARVLAVERYLRDQQLLGIWGCSGKLICCTNVPWNSSWSNKSYSEIWDNMTWLQWDKEVSNYTQIIYQLIEESQNQQEKNEQDLLALD

SEQ ID NO: 1436 - protein, 635 aa, Artificial Sequence
  Recombinant HIV protein
AENLWVTVYYGVPVWKDAETTLFCASDAKAHDTEKHNVWATHACVPTDPNPQEIHLENVTENFNMWKNNMVDQMHTDIISLWDQSLKPCVQLTPLCVTLNCNHNVTTNNNTNITSEMREEIRNCSFNVTTVQRDKKQKVYSLFYRLDIVQMNEGNNSSNNSANEYRLINCNTSACTQACPKVSFQPIPIHYCAPAGFAILKCRDKEFNGTGVCKNVSTVQCTHGIKPVVSTQLLLNGSLAEEKVMIRTENITDNAKTIIVQLNKTVTINCTRPGNNTRKSIHIGPGQAFYATGDIIGGIRQAHCNVSRKDWNDTLQRVVEQLGNHFNKTIIFDKPSGGDIEITTHSFNCGGEFFYCNTSGLFNSTWKFNGTWNSTDLESNNTVITLPCRIKQIINMWQRVGQCMYAPPIKGVIRCESSITGLLLTRDGGENNSTEIFRPGGGDMRDNWRSELYKYKVVKIEPLGVAPSKCKRRVVGRRRRRRAIGMGAVFLGFLGAAGSTMGAASLTLTVQARQLLSGIVQQQSNLLRAPEAQQQLLRLTVWGIKQLQARVLAVERYLKDQQLLGIWGCSGKLICCTSVPWNSSWSNKSYDEIWGNMTWLQWDKEVSNYTQIIYSLIEESQNQQEKNEQELLALD

SEQ ID NO: 1437 - protein, 639 aa, Artificial Sequence
  Recombinant HIV protein
AENLWVTVYYGVPVWREATTTLFCASDAKSYEKEAHNVWATHACVPTDPNPQEIHMENVTEEFNMWKNSMVEQMHTDIISLWDQSLKPCVKLTPLCVTLQCSDVNVTTNGTANNTVTDNSREEIKNCSFNMTTELRDKERKVHSLFYRLDIVQIDKNNKNNGYRLINCNTSACTQACPKVSFEPIPIHYCAPAGFAILKCKDKEFNGKGQCKNVSTVQCTHGIKPVVSTQLLINGSLAEKEVIIRSENITNNAKTIIVQLAKPVNITCIRPNNNTRKSVRIGPGQAFYTSDIIGNIRQAYCNVSGTEWNDALKQVAIQLGKHFNRTIIFANASGGDLEVTTHSVNCGGEFFYCNTSGLFSSTWNVTYNNNTWNATQVSNSTEPNGTIVIPCRIKQIINMWQRTGQCMYAPPIPGKIQCISNITGLLLTRDGGDTSSMNETFRPGGGDMRDNWRSELYKYKVVKIEPLGVAPTRCQRRVVGRRRRRRAVGLGAVFLGFLGAAGSTMGAASLTLTVQARQLLSGIVQQQNNLLRAPEAQQQLLKLTVWGIKQLQARVLAVERYLRDQQLLGIWGCSGKLICCTNVPWNSSWSNKSYNEIWDNMTWMQWDKEVSKYTETIYGLIEEAQNQQEKNEQDLLALD

SEQ ID NO: 1438 - protein, 630 aa, Artificial Sequence
  Recombinant HIV protein
AENLWVTVYYGVPVWKDAKTTLFCASDAKAYEREVHNVWATHACVPTDPNPQEIYLENVTEEFNMWKNDMVDQMHEDIISLWDQSLQPCVRLTPICVMLNCTDVIHNGTQDPNNITDTDMRNCSFNASTEIRGKKHRTYALFYKLDIVSLNNGINNSEYRLINCNTSACTQACPKVTFDPIPIHYCAPAGYAILKCNNKTFNGTGPCNNVSTVQCTHGIKPVVSTQLLLNGSLAEGEIIIRSKNLTDNAKTIIVQLDSPVKINCTRPNNNTRKSIRIGPGQAFFATGEIIGKIRQAYCNVSRTDWNTTLQKVAIQLRKHLNKSTIEFAKHSGGDLEITTHSFNCGGEFFYCNTSSLFNSTWDNSSITQNYTESNETITLQCRIKQIVNAWQRVEQCIYAPPIQGVIRCDSNITGLLLTRDGGGNNSSENETFRPGGGDMRDNWRSELYKYKVVKLEPLGVAPTKCKRRVVGRRRRRRAVGIGAVFLGFLGAAGSTMGAASMTLTVQARQLLTGIVQQQSNLLRAPEAQQHLLKLTVWGIKQLQARVLAVERYLKDQQLLGIWGCSGKLICCTNVPWNSSWSNKSYDDIWDNMTWLQWDKEISNYTEVIYNLIEQSQNQQEKNEQDLLALD

SEQ ID NO: 1439 - protein, 632 aa, Artificial Sequence
  Recombinant HIV protein
AENLWVTVYYGVPVWKEAKTTLFCASDAKGYDKEVHNVWATHACVPTDPNPQEMVLPNVTEDFNMWKNDMVDQMHEDIISLWDESLKPCVKLTPLCVTLTCKNATNDDTAVKEEMKNCSFSVTTELKDKQKQAYALFYRLDIVQLDNKTSSNNKNSSEEKYRLINCNTSACTQACPKVSFDPIPIHYCAPAGYAILKCNNETFNGTGPCTNVSTVQCTHGIKPVVSTQLLLNGSLAEGEIMIRSENITDNVKTIIVHLNESVEIVCTRPDNNTRKSIRIGPGQAFFATGAIIGKIRQAHCNISKGNWSQTLKGVKNKLQEYFPNKTIEFKQPSPGGDLEITMHSFNCRGEFFYCNTSGLFNNTLLNDTLTIDNNETITLPCRIKQIINMWQEVGRCMYAPPIAGNITCKSNITGLLLVRDGGISNGTDNKNETFRPGGGDMRNNWRSELYKYKVVEIKPLGVAPTRCRRRVVGRRRRRRAVGIGAVIFGFLGAAGSTMGAASIALTVQARQLLSGIVQQQGNLLRAPEAQQHLLQLTVWGIKQLQARVLALERYQRDQQLLGIWGCSGKLICCTNVPWNISWSNRSHDYIWENLTWMDWEREIDNYTGTIYTLLEISQNQQERNEQDLLALD

SEQ ID NO: 1440 - protein, 626 aa, Artificial Sequence
  Recombinant HIV protein
AENLWVTVYYGVPVWKDAETTLFCASDARAYEKEAHNIWATHACVPTDPDPQELYLENVTEEFNMWKNNMVEQMHTDIISLWDQSLKPCVQLTPLCVTLNCNDVTNNGTNVANISIDMKGEIKNCSFNMTTELRDKKQKVYSLFYKLDVVQMNSSQYRLINCNTSACKQACPKVSFEPIPIHYCAPAGFAILKCRDEEFDGTGPCTNVSTVQCTHGIKPVVSTQLLLNGSLAEKRVMVRSENITNNVKNIIVQFNETVNITCIRPNNNTRKSVHIGPGQAFYATGDIIGNIRKAHCHVNKTEWNRMLAKAAQQLINHFNKTITFKNSSGGDLEITSHSFNCGGEFFYCDTSSLFNITWDRSNVTQELNNTKLNDTIILQCRIKQIINMWQRAGQCMYAPPIPGIIKCESNITGLILTRDGSENETETFRPGGGDMRDNWRSELYKYKVVKIEPLGVAPTKCRRRVVGRRRRRRAVGLGAVFLGFLGAAGSTMGAASITLTVQVRQLLSGIVQQQNNLLRAPEAQQHLLKLTVWGIKQLQARVLAVERYLKDQQLLGIWGCSGKLICCTNVPWNNSWSNKSLEDIWENMTWMQWDKEINNYTHLIYNLIEESQYQQEKNEKELLELD

SEQ ID NO: 1441 - protein, 646 aa, Artificial Sequence
  Recombinant HIV protein
AENLWVTVYYGVPVWKEATTTLFCASDAKAYNPEMHNVWATHACVPTDPNPQEMVLENVTENFNMWENNMVEQMHEDIISLWDQSLKPCVKLTPLCVTLNCRNANITDITTVDKPIVGDIQNCSFNVTTEINDRKKKMHALFYRLDVVPLNKRNSSTNNNSNNESTMDYRLINCNTSACTQACPKVSFEPIPIHYCAPAGYAILKCNSKTFNGTGPCTNVSTVQCTHGIRPVVSTQLLLNGSLAEEEIIVRSENVTNNAKTIIVHLNESVQINCTRPNNNTRESIRIGPGQSLYANGDIIGDIRQAHCNISRGEWNKTLQQVAEKLGNLFNKTEIIFSPSSGGDPEITTHSFNCGGEFFYCNTTGLFNDSKWQHNNSEWEETSKRMNSPEANITLQCRIKQIVNMWQGVGRCMYAPPIRGVIKCTSNITGLLLTRDGGLNTSNNETFRPGGGDMRDNWRSELYKYKVVRIEPLGLAPTKCKRRVVGRRRRRRAIGMGALFLGFLGTAGSTMGAASLTLTVQARQLLSGIVQQQNNLLRAPEAQQHLLQLTVWGVKQLQARILAVERYLRDQQLLGIWGCSGKHICCTTVPWNSSWSKNRTLNDIWENMTWMQWEREIDNYTVEIYRLLEESQTQQEKNEKELLELD

SEQ ID NO: 1442 - protein, 629 aa, Artificial Sequence
  Recombinant HIV protein
AENLWVTVYYGVPVWKEAKTTLFCASDAKAYEKEVHNVWATHACVPTDPSPQEIVLNVTENFNMWKNDMVDQMHEDVISLWDQSLKPCVKLTPLCVTLNCSDIAKNNSSNGTNNNNITSDMKEEMKNCSFNATTEIRDKKKEMYALFYKLDIVSLVANTSEYRLKNCNTSTCTQACPKVSFDPIPIHYCAPAGFAILKCNDKTFNGTGPCHNVSTVQCTHGIKPVVSTQLLLNGSLAEKEIIIRSANLSDNAKTIIVHLNESVEIVCTRPSNNTRKSIRIGPGQMFFATNEIIGDIRQAHCNISGANWSKTLDRVSEKLRKHFPNKTIIFNSSSGGDPEITTHSFNCGGEFFYCNTSKLFNNTYNGTESNSTITLPCRIKQIINMWQGVGRCMYAPPIAGNITCKSMITGLLLVRDGGTGKNDTENATETFRPEGGDMRDNWRSELYKYKVVEIKPLGIAPTECKRRVVGRRRRRRAVGIGAVFLGFLGAAGSTMGAASITLTVQARQLLSGIVQQQNNLLRAPEAQQHMLQLTVWGIKQLQARVLAIERYLKDQQLLGLWGCSGKLICCTSVPWNSSWSNKSYTEIWDNMTWIQWDREINNYTNIIYGLLEVSQTQQEINEKELLALD

SEQ ID NO: 1443 - protein, 628 aa, Artificial Sequence
  Recombinant HIV protein
AENLWVTVYYGVPVWKDAETTLFCASDAKAYHTEVHNVWATHACVPTDPNPQEINLENVTEEFNMWKNKMVEQMHTDIISLWDQSLKPCVQLTPLCVTLDCQYNVTNINSTSDMAREINNCSYNITTELRDREQKVYSLFYRSDIVQMNSDNSSKYRLINCNTSACKQACPKVTFEPIPIHYCAPAGFAILKCKDKEFNGTGPCKNVSTVQCTHGIKPVVSTQLLLNGSLAEEKVMIRSENITDNAKNIIVQFKEPVKINCTRPNNNTRKSVRIGPGQTFYATGEIIGDIRQAHCNVSKAHWENTLQEVANQLKLMIHSNKTIIFANSSGGDLEITTHSFNCGGEFFYCYTSGLFNYTFNDTSTNSTESKSNDTITLQCRIKQIINMWQRAGQCVYAPPIPGIIRCESNITGLILTRDGGNNNSNTNETFRPGGGDMRDNWRSELYRYKVVKIEPIGVAPTTCKRRVVGRRRRRRAVGIGAVFLGFLGAAGSTMGAASITLTVQARQLLSGIVQQQSNLLRAPEAQQHLLKLTVWGIKQLKARVLAVERYLKDQQLLGIWGCSGKLICCTNVPWNSSWSNKSLGEIWDNMTWLQWDKEIENYTQIIYELIEESQNQQEKNEQDLLALD

SEQ ID NO: 1444 - protein, 649 aa, Artificial Sequence
  Recombinant HIV protein
AENLWVTVYYGVPVWKEATTTLFCASDAKAYKAEAHNIWATHACVPTDPNPQEIVLGNVTENFNMWKNDMVEQMHEDIISLWEQSLKPCVKLTPLCVTLNCTNATATNATATSQNSTDGSNKTVNTDTGMKNCSFNVTTDLKDKKRQDYALFYKLDVVQIDDKNTNGTNTNYRLINCNTSACTQACPKITFEPIPIHYCAPAGYAILKCNNKTFNGTGPCKNVSTVQCTHGIRPVVSTQLLLNGSLAEEEIVIRSENLTNNAKIIIVQLNEAVTINCTRPSNNTRRSVHIGPGQAIYSTGQIIGDIRKAHCNISRKEWNSTLQQVTKKLGSLFNTTKIIFNASSGGDPEITTHSFNCNGEFFYCNTAGLFNSTWNRTNSEWINSKWTNKTEDVNITLQCRIKQIINMWQGVGKCMYAPPVSGIIRCSSNITGLLLTRDGGGADNNRQNETFRPGGGDMRDNWRSELYKYKVVRIEPLGIAPTKCRRRVVGRRRRRRAIGLGALFLGFLGTAGSTMGAVSMTLTVQARQVLSGIVQQQNNLLRAPKAQQHLLQLTVWGIKQLQARILAVESYLKDQQLLGIWGCSGKHICCTNVPWNSSWSNKSLDYIWKNMTWMEWEKEIDNYTELIYSLIEVSQIQQEKNEQELLKLD

SEQ ID NO: 1445 - protein, 629 aa, Artificial Sequence
  Recombinant HIV protein
AENLWVTIYYGVPVWKEAKTTLFCASDAKSYEAEAHNIWATHACVPTDPNPQEIELENVTENFNMWKNNMVEQMHEDIISLWDQSLKPCVKLTPLCVTLNCSNNGTTANITDSGIEIKNCSFNITTEVRDRKKQVYALFYKLDVVPLDTDTNTSNYRLINCNTSACTQACPKVTFEPIPIHYCAPAGYAILKCNDKTFNGTGPCKNVSTVQCTHGIKPVVSTQLLLNGSLAEEEVIIRSENLTNNAKIIIVQLNESVEITCMRPYNNTRQGVHIGPGRAYYTTNIIGNIRQAYCNISSKNWNKTLQQVAKKLGGLVNKTTILFKPPSGGDPEITTHSFNCGGEFFYCNTSGLFNSTWNNSMWNNMLTWNATGNDIMTLPCKIKQIINMWQGVGKCMYAPPIEGLIQCSSNITGLLLTRDGGVNNDSQSETFRPGGGDMRDNWRSELYKYKVVRIEPIGLAPTRCKRRVVGRRRRRRAIGLGAMFLGFLGAAGSTMGAASLTLTVQARELLSGIVQQQNNLLRAPEAQQHLLQLTVWGIKQLQARVLAVESYLKDQQLLGIWGCSGKHICCTTVPWNSSWSNKSVEEIWKNMTWMEWEREIDNYTGLIYSLITESQTQQEKNEQELSQLD

SEQ ID NO: 1446 - protein, 634 aa, Artificial Sequence
  Recombinant HIV protein
AENLWVTVYYGVPVWRDADTTLFCASDAKVHSTEVHNVWATHACVPTDPNPQEIHLENVTENFNMWQNKMAEQMQEDVISLWDQSLKPCIKLTPLCVTLSCTEAKFNETFNKIDNITKVSNLTDEMRNCSFNMTTELRDKKQQVYALFYKLDIVPIDNSSEYRLINCNTSVCKQACPKVSFDPIPIHYCTPAGYAILKCNDKNFNGTGPCKNVSSVQCTHGIKPVVSTHLLLNGSLAEEEIVIRSEDITKNTKTIIVHLNKSVEINCTRPSNNTRTSVRIGPGQVFYRTGEVITSIRKAYCEINGTKWNETLRQVAKKLKEHFKNKTIIFQPPSGGDLEVTTHHFNCRGEFFYCDTAQLFNSTWRGNETKEERNGTSNDIIILPCRIKQIVRMWQGVGQCMYAPPISGIINCVSNITGILLTSDGDGGPTADNETFRPAGGDMRDNWRSELYKYKVVQIEPLGIAPTRCKRRVVGRRRRRRAVGIGAMIFGFLGAAGSTMGAASITLTVQARQLLSGIVQQQSNLLRAPEVQQHLLQLTVWGIKQLQARVLAVERYLKDQKFLGLWGCSGKIICCTAVPWNSTWSNKSYEDIWYNMTWIEWEREISNYTSQIYEILTESQNQQDRNEKDLLELD

SEQ ID NO: 1447 - protein, 621 aa, Artificial Sequence
  Recombinant HIV protein
AENLWVTVYYGVPVWREATTTLFCASDAKGYEREVHNVWATHACVPTDPNPQEIVLKNVTENFNMWKNDMVDQMHEDIISLWEQSLKPCVKLTPLCVTLICRNVNLTNNNSISGNDSMSGEMRNCSFNMTTELRDKKKNVSALFYKLDVVPIDGRENNSEYRLINCNTSACTQACPKVSFDPIPIHYCAPAGYAILKCNNETFNGTGPCRNVSTVQCTHGIKPVVSTQLLLNGSLAEKDIMIRSENLTNNAKIIIVHLNESIEIKCIRPGNNTRQSIRIGPGQAFYAYTNIIGDIRKAHCKINGTKWNETLEKVKSILREFFNKTVKFQPHSGGDLEVVTHSFNCRGEFFYCNTSQLFNETHTNGTNSTIILPCRIKQIINMWQEVGRCMYAPPIAGNITCTSNITGLLLERDGGKDNNMTEIFRPGGGDMRDNWRSELYKYKVVEIKPLGVAPTKCKRRVVGRRRRRRAALGAVFLGFLGAAGSTMGAASITLTVQARQLLSGIVQQQSNLLRAPEAQQHLLQLTVWGIKQLQTRVLAIERYLKDQQLLGIWGCSGKLICCTNVPWNSSWSNKSQEEIWDNMTWIQWDREVSNYTDTIYRLLEDSQNQQEKNEKDLLALD

SEQ ID NO: 1448 - protein, 636 aa, Artificial Sequence
  Recombinant HIV protein
AENLWVTVYYGVPVWKEAKTTLFCASDAKSYETEAHNIWATHACVPTDPNPQEVELVNVTENFNMWKNDMVDQMHEDIISLWDESLKPCVKLTPLCVTLQCSEMKNGTRGASNSTGTNNGTISSTDRMNCSFNATTVVNDKQKKVHALFYRLDIEPIGNNSTEYMLINCNTSACAQSCPKITFEPIPIHYCAPAGFALLKCRDKQFNGTGPCTNVSSVQCTHGIKPVVSTQLLLNGSLAEEDIIIRSENLTDNTKTIIVQLNKSIAINCTRPYNNTRQRIHIGPGQAIWTNDARVIVGDIRQAHCNVSRVDWNNMTQWAATKLGSLYNRSTIIFNHASGGDPEITTHSFTCGGEFFYCNTSGLFNSTWDIMNTSSPNNTDPIITLQCRIKQIINMWQGVGRCIYAPPIAGQILCSSNITGLLLTRDGGADNSSHNETFRPGGGNMKDNWRSELYKYKVVKIEPLGIAPTKCRRRVVGRRRRRRAIGLGAMFLGFLGAAGSTMGAASVTLTVQARQLLSGIVQQQSNLLRAPQAQQHLLQLTVWGIKQLQARVLAVERYLKDQQLLGIWGCSGKHICCTNVPWNSSWSNRSLDDIWQNMTWMQWEREIDNYTGLIFSLIEESQIQQEKNEKELLELD

SEQ ID NO: 1449 - protein, 646 aa, Artificial Sequence
  Recombinant HIV protein
AENLWVTVYYGVPVWREAKTTLFCASDAKGYEKEVHNVWATHACVPTDPNPQEMKLGNVTENFNMWENDMVDQMHEDVISLWDQSLKPCVKLTPLCVTLNCSHAVRVTGNNDTATRKNTTVDNNNTVDDSTMDEQMKNCSFNVTTELRDKEKEQYALFYTVDVVNDSSTYRLINCNSSTCTQACPKVSFDPIPIHYCAPAGYAILKCNNKTFNGTGPCNDVSTVQCTHGIKPVVSTQLLLNGSLAEEEIVIRSKDLNNTGNTIIVHLNKSIEIMCTRPGNNTRQSIRIGPGQTFYATGDIIGDIRQAYCNISKVKWNETLQMVGKKLREHYNFTNKGKIKFSPHPGGDLEVTMHSFNCRGEFFYCNTSKLFNSTYMPGYWPNATERNSTSNITLHCRIKQIINMWQGVARCMYAPPIRGNITCISNITGLLLTWDGDKTSNDPDTDVFRPGGGNMKDNWRSELYKYKVVEIKPLGIAPTRCKRRVVGRRRRRRAVGIGAVLLGFLGAAGSTMGVASITLTVQARQLLSGIVQQQSNLLRAPEAQQHMLQLTVWGIKQLQARVLAIERYLQDQQLLGIWGCSGKLICCTTVPWNQSWTNKSYGEIWGNMTWMEWDREISNYSSAIYWLLEESQKQQDKNEKDLLALN

SEQ ID NO: 1450 - protein, 629 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDVISLWDQSLKPCVKLTPLCVTLDCKNVNDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKNQVMIRSEHIGNSAKNIIVQFTEPVKINCTRPNNNTRKSVHIGPGQAFYATGDIIGNIRQAYCTVNRTAWNNTLQKVVTRLRTYFGNKTIIFKNSSGGDIEITTHSFNCAGEFFYCNTSSLFNSTWPVSGQGLNSTELGDTITLQCRIKQIINMWQRAGQCIYAPPIPGVIRCESNITGLILTSDYGNNNSDNEIFRPTGGDMRDNWRSELYKYKVVKIEPIGVAPTKCRRRVVGRRRRRRAVGLGAVFIGFLGAAGSTMGAASVTLTVQARQLLSGIVQQQSNLLRAPEAQQHMLKLTVWGIKQLQARVLAVERYLRDQQLLGIWGCSGKLVCCTNVPWNSSWSNKSLSEIWENMTWLQWDKEINNYTQIIYTLIEESQTQQEKNEQELLALD

SEQ ID NO: 1451 - protein, 629 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCKNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKNQVMIRSEHIENNAKNIIVQFTEPVKINCTRPNNNTRKSVHIAPGQAFYATGDIIGNIRQAYCTVNRTAWNNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNSSSDNETFRPTGGDMRDNWRSELYKYKVVKIEPIGVAPTKCRRRVVGRRRRRRAVGLGAVFIGFLGAAGSTMGAASVTLTVQARQLLSGIVQQQSNLLRAPEAQQHMLKLTVWGIKQLQARVLAVERYLRDQQLLGIWGCSGKLVCCTNVPWSSSWSNKSLSEIWENMTWLQWDKEINNYTQIIYTLIEESQTQQEKNEQELLALD

SEQ ID NO: 1452 - protein, 629 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPIGVAPTKCRRRVVGRRRRRRAVGLGAVFIGFLGAAGSTMGAASVTLTVQARQLLAGIVQQQSNLLRAPEAQQHMLKLTVWGIKQLQARVLAVERYLRDQQLLGIWGCSGKLVCCTNVPWNSSWSNKSLSEIWENMTWLQWDKEINNYTQIIYTLIEESQTQQEKNEQELLALD

SEQ ID NO: 1453 - protein, 649 aa, Artificial Sequence
  Recombinant HIV protein
AENLWVTVYYGVPVWKEAKTTLFCASDAKAYEREVHNVWATHACVPTDPNPQEMELKNVTENFNMWKNDMVDQMHEDVISLWDESLKSCVKLTPLCVTLYCTNVNSTAPNSTAATSTTTSSSTTSSSTTTATYNEMTNCSFNATTELRNKEKKEYALFYRLDVVKLNEESDSNSSNSNTYRLINCNTSTCTQACPKVSFEPIPIHYCAPAGYAILKCNNETFNGTGPCNNVSTVQCTHGIKPVVSTQLLLNGSLAEKDIVIRSENLTNNAKIIIVSLNESVSINCTRPNNNTRKGIRIGPGQTFYATGEIIGNIREAHCNISREDWNKTLQRVGKKLEEHFPNKTIIFESHSGGDLEITTHSFNCGGEFFYCNTSALFNSTYNETYRYNATNDTNPTITLKCRIKQIINMWQEVGRCMYAPPIAGNITCRSNITGILLTRDGGPNSTNETFRPEGGDMRNNWRSELYKYKVVEIKPLGIAPTKCKRRVVGRRRRRRAVGIGALFLGFLGAAGSTMGAASITLTVQARQLLSGIVQQQSNLLRAPEAQQHMLQLTVWGIKQLQARVLAIERYLQDQQLLGIWGCSGKLICCTAVPWNSSWSNKNITYIWGNMTWMQWEKEIDNYTGTIYRLLEESQNQQEKNEQELLELG

SEQ ID NO: 1454 - protein, 643 aa, Artificial Sequence
  Recombinant HIV protein
AENLWVTVYYGVPVWKEAKTTLFCASDAKAYEREVHNVWATHACVPTDPNPQEMVLKNVTENFRWENDMVDQMHENIIDLWDQSLKPCVKLTPLCVTLNCSNVNSNVNVTSNGTASQGNATYTNRMEEEIKNCSFNITTEIRGKKQKVHALFYKLDVVPLNGDSSNSSEYRLINCNTSACTQACPKVSFDPIPIHFCAPAGYAILKCNDKTFNGTGPCNNVSTVQCTHGIKPVISTQLLLNGSLAEGEIIIRSKNLTDNVQTITVHLNESISINCTRPNNNTRKSIRIGPGQIFYATGDIIGDIREAHCNISASQWNAALKGVKAKLKEHFSNKTINFTTSSGGDLEITTHSFNCRGEFFYCNTSGLFNETGLFNETHNSTMNDNITLPCRIKQIINMWQEVGRCVYAPPIAGNIACNSNITGLLLTRDGGSINGSEDENNTEIFRPGGGNMKDNWRSELYKYKVVEIKPLGIAPTACKRRVVGRRRRRRAVGLGAVFLGFLGAAGSTMGAASITLTAQARRVLSGIVQQQSNLLRAPEAQQHMLQLTVWGTKQLQARVLAIERYLKDQQLLGLWGCSGKLICCTAVHWNDSWSNKSVIDIWDNMTWMQWDKEIRNYTNTIYRLLEDSQTQQEKNEKDLLALD

SEQ ID NO: 1455 - protein, 631 aa, Artificial Sequence
  Recombinant HIV protein
AENLWVTVYYGVPVWKEAKTTLFCASDAKAYEREVHNVWATHACVPTDPNPQEMFLVNVTENFRWENDMVDQMHENIISLWDQSLKPCVKLTPLCVTLTCSSVNVTSQDNATYTNSMKGEIKNCSFNITTEIRDKKKKVHALFYKLDVVPLNGGSNSSEYRLINCNTSACTQACPKVSFDPIPIHFCAPAGYAILKCNDKTFNGTGPCNNVSTVQCTHGIKPVISTQLLLNGSLAEGEIIIRSKNLTDNVQTITVHLNESISINCTRPNNNTRKSIRIGPGQIFYATGDIIGDIREAHCNISARQWNAALKSIKAKLKEHFNKTINFTTSSGGDLEITTHSFNCRGEFFYCNTSGLFNETGLFNETHNSTMNDNITLPCRIKQIINMWQEVGRCIYAPPIAGNIACNSNITGLLLTRDGGSINGSEDNTEIFRPGGGNMKDNWRSELYKYKVVEIKPLGIAPTECKRRVVGRRRRRRAVGGFGAMILGFLGAAGSTMGAASITLTAQARQVLSGIVQQQSNLLRAPEAQQHMLQLTVWGIKQLQARVLAIERYLKDQQLLGLWGCSGKLICCTAVHWNDSWSNKSVKDIWENMTWMQWDKEISNYTNIIYTLLEDSQTQQEKNEKDLLALD

SEQ ID NO: 1456 - protein, 617 aa, Artificial Sequence
  Recombinant HIV protein
AENLWVTVYYGVPVWREAKTTLFCASDAKAYEKEVHNVWATHACVPTDPDPQEMVLKNVTENFNMWKNDMVEQMHEDIISLWDQSLKPCVKLTPLCVTLTCTNVNATDNVTYKEKMEGEIKNCSFNITTEIRDKKRKVHALFYRLDVVQLNNSNEYILINCNTSACTQACPKVSFDPIPIHYCAPAGYAILKCNDKTFNGTGPCHNVSTVQCTHGIKPVISTQLLLNGSLAEKEVIIRFENLTDNAKTIIVQLNQSIEIKCIRPNNNTRESIRIGPGQAFYATRDIIGDIRRAYCTIETERWKETLGNVTEKLKEYFPNTNISFAPSSGGDLEITTHSFNCRGEFFYCNTSKLFNNNDTENNLTITLPCRIKQIVNMWQGVGRCMYAPPIEGNITCKSNITGLLLTRDGGNGTERNETFRPGGGDMRNNWRSELYKYKVVEIKPLGIAPTGCKRRVVGRRRRRRAVGMGAVFLGFLGAAGSTMGAASLTLTVQARQVLSGIVQQQSNLLRAPEAQQHMLQLTVWGIKQLQTRVLAIERYLKDQQLLGLWGCSGKLICCTAVPWNSSWSNKSEIDIWNNMTWMQWDREISNYTNTIYRLLEDSQTQQEKNEKDLLALD

SEQ ID NO: 1457 - protein, 634 aa, Artificial Sequence
  Recombinant HIV protein
AENLWVTIYYGVPVWREATTTLFCASDAKAYDTEVHNVWATHACVPTDPNPQEVVLGNVTENFNMWKNNMVDQMHEDIISLWDESLKPCVKLTPLCVTLNCTNLNITKNTTNPTSSSWGMMEKGEIKNCSFYITTSIRNKVKKEYALFNRLDVVPIENTNNTKYRLISCNTSVCTQACPKVSFQPIPIHYCVPAGFAMLKCNNKTFNGSGPCTNVSTVQCTHGIRPVVSTQLLLNGSLAEEDIVIRSENFTDNAKTIIVQLNESVVINCTRPNNNTRRRLSIGPGRAFYARRNIIGDIRQAHCNISRAKWNNTLQQIVIKLREKFRNKTIAFNQSSGGDPEIVMHSFNCGGEFFYCNTAQLFNSTWNVTGGTNGTEGNDIITLQCRIKQIINMWQKVGKCMYAPPITGQIRCSSNITGLLLTRDGGNSTETETEIFRPGGGDMRDNWRSELYKYKVVRIEPIGVAPTRCKRRTVGRRRRRRAVGIGAVFLGFLGAAGSTMGAASVTLTVQARLLLSGIVQQQNNLLRAPEAQQHMLQLTVWGIKQLQARVLALERYLRDQQLMGIWGCSGKLICCTSVPWNVSWSNKSVDDIWNNMTWMEWEREIDNYTDYIYDLLEKSQTQQEKNEKELLELD

SEQ ID NO: 1458 - protein, 640 aa, Artificial Sequence
  Recombinant HIV protein
AENLWVTVYYGVPVWRDAETTLFCASDAKAYDKEAHNVWTTHACVPTDPDPQELPLVNVTEEFNMWKNNMVEQMHEDIISLWDQSLKPCVQLTPLCVTLECADAQNVTDTNTTISNEMQGEIKNCSFNMTTELRDKKKKVYALFYRPDVIEINKTKINNSNSSQYMLINCNTSACTQACPKVSFEPIPIHYCAPAGFAILKCNDTEFSGKGTCKSVSTVQCTHGIKPVVSTQLLLNGSLAEGKIAIRSENISNNAKTIIVQLTEPVEINCIRPGNNTRKSVRIGPGQTFYATGDIIGDIRQAHCNVSKIAWEETLQKIAAQLRKHFQNATIKFTKHSGGDLEITTHSFNCGGEFFYCNTTKLFNSTWNNDNYNVSANLTEENRKENITLHCRIKQIVNMWQRVGQCIYAPPIPGNITCGSNITGLLLTRDGGNNGTNDTETFRPGGGDMRDNWRSELYKYKVVKIEPLGVAPTPCKRRVVGRRRRRRAVGMGALIFGFLGAAGSTMGAASMALTVQARQLLSGIVQQQSNLLKAPEAQQHLLRLTVWGIKQLQARVLALERYLKDQQLLGIWGCSGKLICCTAVPWNSSWSNKSYNDIWDNMTWLQWDKEINNYTYIIYNLLEKSQNQQEINEQDLLALD

SEQ ID NO: 1459 - protein, 642 aa, Artificial Sequence
  Recombinant HIV protein
AENLWVTVYYGVPVWKEAKTTLFCASDAKSYEKEVHNVWATHACVPTDPNPQEIVLGNVTENFNMWKNDMVDQMHEDIISLWDQSLKPCVKLTPLCVTLNCTEVNVTRNVNNSVVNNTTNVNNSMNGDMKNCSFNITTELKDKKKNVYALFYKLDIVSLNETDDSETGNSSKYYRLINCNTSACTQACPKVSFDPIPIHYCAPAGYAILKCNNKTFNGTGPCHNVSTVQCTHGIKPVVSTQLLLNGSLAEEGIIIRSENLTNNVKTIIVHLNRSIEIVCVRPNNNTRQSIRIGPGQTFYATGDIIGDIRQAHCNISRTNWTKTLREVRNKLREHFPNKNITFKPSSGGDLEITTHSFNCRGEFFYCNTSGLFSINYTENNTDGTPITLPCRIRQIINMWQEVGRCMYAPPIEGNIACKSDITGLLLVRDGGSTNDSTNNNTEIFRPAGGDMRDNWRSELYKYKVVEIKPLGIAPTECKRRVVGRRRRRRAVGIGAVFLGFLGAAGSTMGAASITLTAQARQVLSGIVQQQSNLLRAPEAQQHLLQLTVWGIKQLQTRVLAIERYLKDQQLLGLWGCSGKLICCTAVPWNISWSNKSKTDIWDNMTWMQWDREISNYTNTIYRLLEDSQSQQEQNEKDLLALD

SEQ ID NO: 1460 - protein, 622 aa, Artificial Sequence
  Recombinant HIV protein
AENLWVTVYYGVPVWKEATTTLFCASDAKSYKEEAHNIWATHACVPTDPNPRELIIENVTENFNMWKNNMVEQMHEDIISLWDQSLKPCVKLTPLCVTLNCTEWRKNNTINATGIEMKNCSFNLTTEIRDRKKQVHALFYKLDVVPIDDNNSTNTSYRLINCNTSACTQACPKVTFEPIPIHYCAPAGYAILKCNNKKFNGTGPCNNVSTVQCTHGIRPVVSTQLLLNGSLAEEDIIIRSENLTNNAKIIIVQLNESVTINCTRPYNNTRRGVHIGPGRAYYTTDIIGDIRQAHCNISGAEWNKTLHRVAKKLRDLFKKTTIIFKPSSGGDPEITTHSFNCRGEFFYCNTTRLFNSIWGNNSTGVDESITLPCRIKQIINMWQGVGKCMYAPPIEGLISCSSNITGLLLTRDGGGNESSQNETFRPGGGDMRDNWRSELYKYKVVRIEPLGLAPSKCKRRVVGRRRRRRAIGLGAMFLGFLGAAGSTMGAASLTLTVQARQLLSGIVQQQNNLLRAPETQQHLLQLTVWGIKQLQARVLAVESYLRDQQLLGIWGCSGRHICCTNVPWNSSWSNKTLKSIWDNMTWMEWEREIDNYTGIIYNLLEESQTQQERNEQDLLKLD

SEQ ID NO: 1461 - protein, 640 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVRIEPLGIAPTRCKRRVVGRRRRRRAVGIGALFLGFLGAAGSTMGAASMTLTVQARLLLSGIVQQQNNLLRAPEAQQHLLQLTVWGIKQLQARVLAVERYLRDQQLLGIWGCSGKLICCTAVPWNVSWNNRSVDDIWENMTWMQWDREISNYTSLIYTLIEESQNQQEKNEQELLALD

SEQ ID NO: 1462 - protein, 634 aa, Artificial Sequence
  Recombinant HIV protein
AENLWVTVYYGVPVWKEATTTLFCASDAKAYDTEVHNVWATHACVPTDPNPQEVVLENVTENFNMWKNNMVEQMHEDIISLWDQSLKPCVKLTPLCVTLNCTDLRNVTNINNSSEGMRGEIKNCSFNITTSIRDKVKKDYALFYRLDVVPIDNDNTSYRLINCNTSTCTQACPKVSFEPIPIHYCTPAGFAILKCKDKKFNGTGPCKNVSTVQCTHGIRPVVSTQLLLNGSLAEEEVVIRSSNFTDNAKNIIVQLKESVEINCTRPNNNTRKSIHIGPGRAFYTTGEIIGDIRQAHCNISRTKWNNTLNQIATKLKEQFGNNKTIVFNQSSGGDPEIVMHSFNCGGEFFYCNSTQLFNSTWNFNGTWNLTQSNGTEGNDTITLPCRIKQIINMWQEVGKCMYAPPIRGQIRCSSNITGLILTRDGGTNSSGSEIFRPGGGDMRDNWRSELYKYKVVKIEPLGVAPTKCKRRVVGRRRRRRAVGTIGAMFLGFLGAAGSTMGAASITLTVQARLLLSGIVQQQNNLLRAPEAQQHLLQLTVWGIKQLQARVLAVERYLRDQQLLGIWGCSGKLICCTAVPWNASWSNKSLEQIWNHTTWMEWDREINNYTSLIHSLIEESQNQQEKNEQELLELD

SEQ ID NO: 1463 - protein, 634 aa, Artificial Sequence; identical to SEQ ID NO: 1058
  Recombinant HIV protein

SEQ ID NO: 1464 - protein, 634 aa, Artificial Sequence
  Recombinant HIV protein
AENLWVTVYYGVPVWKEATTTLFCASDAKAYDTEVHNVWATHACVPTDPNPQEVKMENVTENFNMWKNNVVEQMHEDIISLWDQSLKPCVKLTPLCVTLNCTDLKNATNGNNTNTTSSSGGMMGGGEMKNCSFNITTNIRGKVQKEYALFYELDIVPIDNKIDSYRLISCNTSVCTQACPKVSFEPIPIHYCAPAGFAILKCKDKKFNGKGPCSNVSTVQCTHGIRPVVSTQLLLNGSLAEEEVVIRSENFTNNAKIIVVQLNESVEINCTRPNNNTRKSIHIGPGRAFYTTGEIIGDIRQAHCNLSRAKWNDTLNKIVIKLREQFGNKTIVFKHSSGGDPEIVTHSFNCGGEFFYCNSTQLFNSTWNVTEESNNTVENNTITLPCRIKQIINMWQEVGRCMYAPPIRGQIRCSSNITGLLLTRDGGPEDDKTEVFRPGGGDMRDNWRSELYKYKVVKIEPLGVAPTKCKRRVVGRRRRRRAVGIGAVLLGFLGAAGSTMGAASMTLTVQARLLLSGIVQQQNNLLRAPEAQQHLLQLTVWGIKQLQARVLAVERYLRDQQLLGIWGCSGKLICCTAVPWNASWSNKSLNKIWDNMTWMEWDREINNYTSIIYSLIEESQNQQEKNEQELLELD

SEQ ID NO: 1465 - protein, 629 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNISEGKEEIKNCSFNITTELRDKRKKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGNIRQAHCNVSRSEWNKTLQQVAKQLGKYFGNKKVIFNSSSGGDLEITTHSFNCGGEFFYCNTSGLFNSTWTWDNSTWNQVNSTESNDTIILQCRIKQIINMWQRTGQCIYAPPIQGEIRCVSNITGLLLTRDGGNNNGTSETFRPEGGNMRDNWRSELYKYKVVEIEPLGVAPTRCKRRVVGRRRRRRAVGIGAVFLGFLGAAGSTMGATSITLTVQARQLLSGIVQQQNNLLRAPEAQQHLLKLTVWGIKQLQARVLAVERYLRDQQLLGIWGCSGKLICCTNVPWNSSWSNKSLDEIWNNMTWLQWDKEINNYTQLIYRLIEESQNQQEKNEKELLELD

SEQ ID NO: 1466 - protein, 640 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLNCSNANVNITGNITGVGEDIKNCSFNMTTELRDKKQKVYSLFYRLDVVQINENQGNSSNNNYSEYRLINCNTSACTQACPKVSFEPIPIHYCAPAGFAILKCKDEEFNGTGPCKNVSTVQCTHGIKPVVSTQLLLNGSIAEKEVKIRSEDITNNAKNILVQLVNPVKINCTRNADNKRRSIRIGPGQAFYATGEIIGDIRKAQCTVNRTDWNNTLQQVANQLRKYLGNKTIIFASSSGGDLEITTHSFNCGGEFFYCNTSGLFNSIWYHNDSSISLDPNSTESNDNITLPCRIKQIINMWQRAGQCMYAPPIEGVIMCVSNITGLILTRDGGNDSSTNENETFRPGGGDMRDNWRSELYKYKVVEIEPLGVAPTRCKRRVVGRRRRRRAVGIGAVFLGFLGAAGSTMGATSITLTVQARQLLSGIVQQQNNLLRAPEAQQHLLKLTVWGIKQLQARVLAVERYLRDQQLLGIWGCSGKLICCTNVPWNSSWSNKSLDEIWNNMTWLQWDKEINNYTQLIYRLIEESQNQQEKNEKELLELD

SEQ ID NO: 1467 - protein, 650 aa, Artificial Sequence; identical to SEQ ID NO: 1059
  Recombinant HIV protein

SEQ ID NO: 1468 - protein, 648 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVEIEPLGVAPTRCKRRVVGRRRRRRAVGIGAVFLGFLGAAGSTMGATSITLTVQARQLLSGIVQQQNNLLRAPEAQQHLLKLTVWGIKQLQARVLAVERYLRDQQLLGIWGCSGKLICCTNVPWNSSWSNKSLDEIWNNMTWLQWDKEINNYTQLIYRLIEESQNQQEKNEKELLELD

SEQ ID NO: 1469 - protein, 643 aa, Artificial Sequence
  Recombinant HIV protein
AENLWVTVYYGVPVWKEATTTLFCASDAKAYDKEKHNVWATHACVPTNPNPQEIDLINVTEEFNAWENNMVEQMHEDIISLWDQSLKPCVELTPLCVTLNCTDQRKNTSPLGEAEKMEKGEMKNCSFKVTTRLRNKVQKEYALFNKLDVVPIDNDNKTNTNYSSYKLISCNTSVCTQACPKVSFEPIPIHYCAPAGFAILKCKDKKFNGTGRCENVSTVQCTHGIRPVVSTQLLLNGSLAEEEVVLRSKNFTQNAETIIVQLNESVVINCTRPNNNTKRSITRGPGRVYYTTGDIVGDIRQAHCNLSRAHWNTTLGHIARKLREKYGENKTIIFNPPIRGGDPEIVMHNFNCGGEFFYCNSTQLFNSTWNDNSDWTWNYTRGTYNPNDTITLPCRIKQIINLWQKVGKCMYAPPIRGQIRCLSNITGLLLTRDGGKNGTEGTEIFRPIGGNMRDNWRSELYKYKVVKIEPLGVAPTKCKRRVVGRRRRRRAVGIGAVFLGFLGAAGSTMGAAAVTLTVQARQLLSGIVQQQNNLLRAPEAQQHMLRLTVWGIKQLQARVLAVERYLKDQQLLGIWGCSGKLICCTAVPWNASWSNKSLDDIWNNMTWMQWEKEIDNYTSLIYTLIEESQNQQDKNEKELLELD

SEQ ID NO: 1470 - protein, 630 aa, Artificial Sequence
  Recombinant HIV protein
AENLWVTVYYGVPVWKEAKTTLFCASDAKAYDTEVHNVWATHACVPTDPNPQEMVLENVTENFNMWENDMVEQMHQDIISLWDQSLKPCVKLTPLCVTLHCSNRTIDYNNRTDNMGGEIKNCSFNMTTEVRDKREKVHALFYRLDIVPLKNESSNTSGDYRLINCNTSACTQACPKVSFDPIPIHYCAPAGYAILKCNNKTFNGTGPCNNVSTIQCTHGIKPVMSTQLLLNGSLAEEEIIIRSKNLTDNVKTIIVHLNESVGINCTRPNNNTRKSIRIGPGQAFYATGEIIGDIRQAHCNISRTAWNKTLQEVGKKLAEHFLNKAIKFAKHSGGDLEITTHSFNCRGEFFYCNTSSLFNSTYTPNSTENITGTENSIITIPCRIKQIINMWQGVGRCMYAPPIEGIITCRSNITGLLLTRDGGTGMHDTEIFRPEGGDMRDNWRSELYKYKVVEIKPLGIAPTKCKRRVVGRRRRRRAVGIGAVFLGFLGAAGSTMGAASITLTVQARQLLSGIVQQQSNLLRAPEAQQHMLQLTVWGIKQLQTRVLAIERYLKDQQLLGIWGCSGKLICCTTVPWNSSWSNRSQEDIWNNMTWMQWDREISNYTNTIYRLLEDSQNQQEKNEQDLLALD

SEQ ID NO: 1471 - protein, 630 aa, Artificial Sequence
  Recombinant HIV protein
AENLWVTVYYGVPVWKEATTALFCASDAKTYDTEVHNVWATHACVPTDPDPQEVELENVTENFNMYKNNMVEQMHEDIINLWDQSLKPCVKLTPLCVTLNCTDLRNATIENVTNPNMKMNKGDIKNCSFHITKNRRGKTQTGYALFSKLDLVPVNDSEYILISCNTSTCTQACPKVSFEPIPIHYCAPAGFAILKCKDKKFNGTGPCKNVSTVQCTHGIRPVVSTQLLLNGSLAEEDVVIRCENFTNNAKTIIVQLNESVVINCTRPNNNTRRGISMGPGRAFLAREQIIGNIRQAHCNLSRTQWSNTLKQTVKKLREQFRNKTIVFNQSSGGDPEIVLHSFNCGGEFFYCNTTQLFNSTWNITRNDNEGSNSTEDIITLPCRIKQIVNLWQEVGKCMYAPPISGQIRCSSNITGLLLTRDGGNTSSEAEIFRPGGGDMRDNWRSELYKYKVVKIEPLGVAPTKCKRRVVGRRRRRRAVGIGALFLGFLGAAGSTMGAASMTLTVQARQLLSGIVQQQNNLLRAPEAQQQMLQLTVWGIKQLQARVLLVERYLKDQQLLGIWGCSGKLICCTAVPWNTSWSNKSLNSIWENMTWMEWDREISNYTNIIYNLIAESQNQQEKNEQELLELD

SEQ ID NO: 1472 - protein, 617 aa, Artificial Sequence
  Recombinant HIV protein
AENLWVTVYYGVPVWKDAETTLFCASDAKAYETEKHNVWATHACVPTDPNPQEMDLENVIEEFNMWKNNMVEQMHTDVISLWDQSLKPCVKLTPLCVTLDCSNHKSIMGEEVKNCSFNMTTELRDKKQKVYSLFYKLDVVPLDEANGNNNSSYRLVNCNTSACTQACPKVTFEPIPIHYCAPAGFAILKCKDKEFSGTGPCKNVSTVQCTHGIKPVVSTQLLLNGSLAEEHVMIRSENITNNAKNILVQLNESVEIYCIRPSNNTRKSVRIGPGQTFYATGEIVGDIRQAHCNVSGSKWNKTLQQVADQLRKHFNTTTIIFANPLGGDLEITTHSFNCGGEFFYCNTSGLFNSTWPSSTQESSDPITLQCRIKQIINMWQRVGQCMYAPPIQGEIRCNSSITGIILTRDGGYNNTNETFRPGGGDMRDNWRSELYKYKVVKIEPLGVAPTKCRRRVVGRRRRRRAVTMGAVFLGFLGAAGSTMGAASLTLTVQARLLLSGIVQQQSNLLRAPEAQQQLLKLTVWGIKQLQARVLAVERYLRDQQLLGIWGCSGKLICCTNVPWNSSWSNKSYSEIWDNMTWLQWDKEVSNYTDIIYKLLEDSQNQQEKNEQDLLALD

SEQ ID NO: 1473 - protein, 624 aa, Artificial Sequence
  Recombinant HIV protein
AENLWVTVYYGVPVWKDATTTLFCASDAKAYDKEVHNVWATHACVPTDPNPQEVVLGNVTENFNMGKNNMVEQMHEDIISLWDQSLKPCVKLTPLCVTLNCTELKNSTDTNLGTQEIKNCSFNITTSVRNKMKREYALFYSLDIVPIDNDNTSYRLRSCNTSICTQACPKVSFEPIPIHFCAPAGFAILKCNNKTFNGTGPCTNVSTVQCTHGIRPVVSTQLLLNGSLAEEEVVIRSENFTNNAKTIIVQLNESVEINCTRPNNNTRKSIHIGPGRAFYTTGDIIGDIRQAHCNISRTNWTNTLKRVAEKLREKFNNTTIVFNQSSGGDPEIVMHSFNCGGEFFYCNTTQLFNSTWNETNSEGNITSGTITLPCRIKQIINMWQEVGKCMYAPPIGGQIKCLSNITGLLLTRDGGSDNSSSGKEIFRPGGGDMRDNWRSELYKYKVVKIEPLGIAPTKCKRRVVGRRRRRRAVGIGAMFLGFLGAAGSTMGAASLTLTVQARQLLSGIVQQQNNLLRAPEAQQHLLQLTVWGIKQLQARVLALERYLQDQRFLGMWGCSGKLICCTAVPWNASWSNKNLSQIWDNMTWMEWEREISNYTEIIYSLIEESQNQQEKNELDLLQLD

SEQ ID NO: 1474 - protein, 631 aa, Artificial Sequence
  Recombinant HIV protein
AENLWVTVYYGVPVWKDADTTLFCASDAKAHETEAHNIWATHACVPTDPNPQEIYMENVTENFNMWKNNMVEQMQEDIISLWDQSLKPCVKLTHLCVTLSCTNVTLTNVNYTNNFPNIGNITDEVRNCSFNVTTEIRDKKQKVYALFYKTDIVQMENKNSYRLINCNTSVCKQACPKISFDPIPIHYCTPAGYAILKCNEKNFNGTGPCKNVSSVQCTHGIKPVVSTQLLLNGSLAEGEIIIRSENLTNNAKTIIVHLNKSVEINCTRPSNNTRTSVTIGPGQVFYRTGDIIGDIRKAYCEINGTKWNETLKQVVGKLKEHFPNKKISFQPPSGGDLEITMHHFNCRGEFFYCNTTQLFNSTWINSTGIKEYNDTIIYLPCKIKQIINMWQGVGQCMYAPPIRGKINCVSNITGILLTRDGGDANATNDTETFRPGGGNIKDNWRSELYKYKVVQIEPLGIAPTKCKRRVVGRRRRRRAVGIGAMIFGFLGAAGSTMGAASITLTVQARQLLSGIVQQQSNLLRAPEAQQHLLQLTVWGIKQLQARVLAVERYLKDQKFLGLWGCSGKIICCTAVPWNSTWSNKSFEQIWNNMTWIEWEREISNYTSQIYDILTESQNQQDRNEKDLLELD

SEQ ID NO: 1475 - protein, 626 aa, Artificial Sequence
  Recombinant HIV protein
AENLWVTVYYGVPVWRDADTTLFCASDAKTHVTEVHNVWATHACVPTDPNPQEIHLGNVTENFNMWKNKMAEQMQEDVISLWDQSLKPCVRLTPLCVTLNCTSANLTNVNNITYAPGIEKITDEVRNCSFNMTTEIKDKKQKVSALFYKLDIVQINSSKNSSEYRLINCNTSVCKQACPKISFDPIPIHYCTPAGYAILKCNDKSFNGTGPCKNVSSVQCTHGIKPVVSTQFLLNGSLAEEEIIIRSENLTNNAKIIIVHLNKSVEINCTRPFNNTRTSVHIGPGQVFYRTGDIIGDIRAVYCEINETQWNETLKQVTRKLEEHFNKTIIFQPPSGGDLEITMHHFNCRGEFFYCNTSKLFNTTNGTIAGSNGTIILPCRIKQIVNMWQGAGQCMYAPPISGRINCVSNITGILLTRDGGNNNTNETFRPAGGNIKDNWRSELYKYKVVQIEPLGIAPTKCKRRVVGRRRRRRAVGIGAMIFGFLGAAGSTMGAASITLTVQARQLLSGIVQQQSNLLRAPEAQQHLLQLTVWGIKQLQARVLAVERYLKDQKFLGLWGCSGKIICCTAVPWNSTWSNKSYEEIWNNMTWIEWEREISNYTSQIYEILTESQNQQERNEKDLLELD

SEQ ID NO: 1476 - protein, 636 aa, Artificial Sequence
  Recombinant HIV protein
AENLWVTVYYGVPVWRDAKTTLFCASDAKAHEREVHNVWATHACVPTDPNPQEILMKNVTENFNMWTNNMVEQMQEDVISLWDQSLKPCVKLTPLCVTLNCTKANLTSDTTNRTTGNRIDEVGNMTDEVKNCTFNMTTELKDKKQKVHALFYKLDIVPIKGNENSSGEYRLINCNTSVCKQACPKISFDPIPIHYCTPAGYAILKCNDKNFNGTGPCKNVSSVQCTHGIKPVVSTQLLLNGSLAEEEIIIRAENLENNAKTIIVHLNKSVEINCTRPSNNTRTSIPIGPGQVFYRTGDIIGNIRKAYCEINGTKWHKVLKQVAEKLREHFINKTIKFRPPLGGDLEITMHHFNCRGEFFYCNTTKLFNSTYRENETREGNDSTIIIPCKIKQIINMWQGTGQCMYAPPISGNINCVSNITGILLTRDGGNNSADNETFRPGGGNIKDNWRSELYKYKVVEIEPLGIAPTRCKRRVVGRRRRRRAVGIGAMIFGFLGAAGSTMGVASITLTVQARQLLSGIVQQQSNLLRAPEAQQHMLQLTVWGIKQLQARVLAVERYLKDQKFLGLWGCSGKIICCTAVPWNTTWSNKSYDEIWENMTWTEWEREISNYTNQIYEILTKSQDQQDRNEKDLLELD

SEQ ID NO: 1477 - protein, 627 aa, Artificial Sequence
  Recombinant HIV protein
AENLWVTVYYGVPVWRDADTTLFCASDAKAQETEAHNIWATHACVPTDPNPQEIHLENVTENFNMWKNNMVEQMQEDVISLWDQSLKPCVKLTPLCVTLNCTTAKVINATIPANVSNIMGNITDEVRNCSFNMTTELRDRKQKAYALFYKLDIVQIKDNKNSSSEYRLINCNTSVCKQACPKVSFDPIPIHYCTPAGYALLKCNDKNFNGTGPCNNVSSVQCTHGIKPVVSTQLLLNGSLAEEEIIISSENLTNNAKTIIVHLNKSVEINCTRPSVNTRTSMHIGPGQVLYRTGDIIGDIRNAYCEIDGTKWSEALELVTEKLKKHFSEIKFQPPSGGDLEITMHHFNCKGEFFYCNTSQLFNNNHKECNGTITLPCRIKQIINMWQGAGQCMYAPPISGKINCVSNITGILLTRDGGTNNNTNSSETFRPGGGNIKDNWRSELYKYKVVQIEPLGIAPTRCKRRVVGRRRRRRAVGIGAMIFGFLGAAGSTMGAASLTLTVQARQLLSGIVQQQSNLLRAPEAQQHLLQLTVWGIKQLQARVLAVERYLKDQKLLGLWGCSGKIICCTAVPWNSTWSNKSYKEIWDNMTWTQWEREISNYTNQIYDILTESQNQQDRNEKDLLELD

SEQ ID NO: 1478 - protein, 633 aa, Artificial Sequence; identical to SEQ ID NO: 1060
  Recombinant HIV protein

SEQ ID NO: 1479 - protein, 639 aa, Artificial Sequence
  Recombinant HIV protein
AENLWVTVYYGVPVWKEAKTTLFCASDAKGYDTEVHNVWATHACVPTDPNPQEIVLENVTENFNMWKNDMVDQMHQDIISLWDQSLKPCVKLTPLCVTLNCSDATYNNGTNSTDTMKICSFNATTELRDKKKKEYALFYRLDIVPLKNESESQNFSEYILINCNTSTCAQACPKVSFDPIPIHYCAPAGYAILKCNNKTFNGTGPCNNVSTVQCTHGIKPVVSTQLLLNGSLAEEEVVIRSENISNNVKTIIVHLNESVNITCIRPGNNTRRSIRIGPGQAFYAMGDIIGNIREAHCNISEKAWNETLKKVVEKLVKYFPNKTIEFAPPVGGDLEITTHSFNCGGEFFYCNTTKLFNSTHNSTDSTVNSTDSTAETGNSTNTNITLPCRIRQIINMWQEVGRCMYAPPSKGNITCISNITGLLLTRDGGENKTENNDTEIFRPGGGDMKDNWRSELYKYKVVEIKPLGVAPTRCKRRVVGRRRRRRAVGIGAVFLGFLGAAGSTMGAASITLTVQARQLLSGIVQQQSNLLRAPEAQQHMLQLTVWGIKQLQTRVLAIERYLKDQQLLGIWGCSGKLICCTNVPWNSSWSNKSYGDIWDNMTWMQWDREINNYTNTIYRLLEDSQNQQEKNEQDLLALD

SEQ ID NO: 1480 - protein, 645 aa, Artificial Sequence
  Recombinant HIV protein
AENLWVTVYYGVPVWKEAKTTLFCASNAKAYEKEVHNVWATHACVPTDPNPQEMVLGNVTENFNMWKNDMVDQMHEDIISLWDESLKPCVKLTPLCVTLICTNVNHSSTNVSHSSTNVSQSSNSSQDNTTIDESMREEIKNCSYNSTTELWDKKQKEYALFYKLDIVPINGNASEYRLINCNTSTCKQACPKVTFEPIPIHYCAPAGYAILKCNNQTFNGTGPCTNVSTVQCTHGIKPVVSTQLLLNGSLAEKEIIISSENLTNNAKIIIVHLKDPVRIVCTRPNNNTRKSIRIGPGQTFYATGDIIGDIRQAYCNIDKGAWNKTLQQVGKKLQEHFPGKTIKFNSSSGGDLEITTHSFNCRGEFFYCNTSKLFNNTYYNGTGNANSTHENITLPCRIKQIIRMWQKVGQCMYAPPIAGNITCTSNITGLLLVRDGGEANGTNNIETFRPGGGDMRDNWRSELYKYKVVEIQPLGIAPTKCKRRVVGRRRRRRAVGIGAMFLGFLGAAGSTMGAASMALTVQSRQLLSGIVQQQSNLLRAPEAQQHMLQLTVWGIKQLRARVVALERYLQDQQLLGIWGCSGKLICCTNVPWNSSWSNRSADIWDNLTWMQWEKEINNYTDTIYQLLEESQIQQEKNEQDLLALN

SEQ ID NO: 1481 - protein, 618 aa, Artificial Sequence
  Recombinant HIV protein
AENLWVTVYYGVPVWKEAKATLFCASDARAYEKEVHNVWATHACVPTDPNPQEIYLGNVTENFNMWKNDMVDQMHEDIISLWDQSLKPCVKLTPLCVTLRCTNATINGSLTEEVKNCSFNITTELRDKKQKAYALFYRPDVVPLNKNSPSGNSSEYILINCNTSTCTQACPKVSFDPIPIHYCAPAGYAILKCNNKTFNGTGPCNNVSTVQCTHGIKPVVSTQLLLNGSLAEEDIIIKSENLTNNIKTIIVHLNKSVEIVCRRPNNNTRKSIRIGPGQAFYATNDIIGDIRQAHCNINNSTWNRTLEQIKKKLREHFLNRTIEFEPPSGGDLEVTTHSFNCGGEFFYCNTTRLFKWSSNVTNDTITIPCRIKQFINMWQGAGRCMYAPPIEGNITCNSSITGLLLTRDGGKTDRNDTEIFRPGGGNMKDNWRNELYKYKVVEIKPLGVAPTECRRRVVGRRRRRRAVGIGAVLLGFLGAAGSTMGAASITLTVQARQLLSGIVQQQSNLLRAPEAQQHMLQLTVWGIKQLQTRVLAIERYLKDQQLLGLWGCSGKLICCTNVPWNSSWSNKSQTDIWDNMTWIQWDREISNYSNTIYKLLEGSQNQQEQNEKDLLALD

SEQ ID NO: 1482 - protein, 633 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVEIKPLGVAPTECKRRVVGRRRRRRAALGAVFLGFLGLAGSTMGAASIALTAQARQLLSGIVQQQSNLLRAPEAQQHLLQLTVWGIKQLQTRVLAIERYLTDQQLLGMWGCSGKLICCTAVPWNTSWSNKSLEKIWKNMTWMQWDKEISNYTDTIYRLLEVSQNQQEENEKDLLALD

SEQ ID NO: 1483 - protein, 645 aa, Artificial Sequence
  Recombinant HIV protein
AENLWVTVYYGVPVWKDATTTLFCASDAKGYETEVHNVWATHACVPTDPNPQELVLGNVTENFNMWKNDMVDQMHEDVISLWDQSLKPCVKLTPLCVTLKCKDVSINNGNVSSSNGSTSHNNSSIDNETLNEGMKEMKNCSFNATTVLRDKKQKVHALFYRLDIVPLNESNKNSRKYRLINCNTSACTQACPKVTFDPIPIHYCAPAGYAILKCNNKTFNGTGPCRNVSTVLCTHGIKPVVSTQLLLNGSLAEEDIIIRSENLTNNAKTIIVHLNESVEIVCTRPGNNTRKGIGIGPGQTFYATGEIIGDIRKAHCNISKDNWTETLYRVSRKLKHFWNKTIIFAPHSGGDLEITTHSFNCRGEFFYCNTSGLFNGTLNDTYMHNSTKSNETITIPCKIRQIVRMWQQVGQCMYAPPIEGNITCKSNITGLLLVRDGGNINRTNETFRPEGGDMRDNWRSELYKYKVVEIKPLGIAPTKCKRRVVGRRRRRRAVGLGAVFLGFLGIAGSTMGAASITLTVQARQLLSGIVQQQNNLLKAPEAQQHLLQLTVWGIKQLQARVLAIERYLKDQQLLGIWGCSGKLICCTAVAWNSSWSNKSLGEIWDNMTWMQWDKEINNYTSIIYSLLEDSQIQQEKNEKDLLALD

SEQ ID NO: 1484 - protein, 636 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVEIKPLGVAPTTCKRRVVGRRRRRRAVGIGAVFLGFLGVAGSTMGAASMTLTVQARQLLSGIVQQQSNLLRAPEAQQHMLQLTVWGIKQLQTRVLAIERYLKDQQLLGIWGCSGKLICCTAVPWNSSWSNKSQTEIWNNMTWMQWDKEISNYTNSIYRLLEESQNQQEKNEKDLLALD

SEQ ID NO: 1485 - protein, 643 aa, Artificial Sequence
  Recombinant HIV protein
AENLWVTVYYGVPVWKEATTILFCASDAKAYDTEAHNVWATHACVPTDPNPQEIFLVNVTENFNMWKNEMVNQMHEDVISLWDQSLKPCVKLTPLCVTLKCKNVNSTGKNVTSTSNGTYNSTYREEMKNCSFNATTALRDRKQTVYALFYRLDIVPLDEKSSSENSRGYYRLINCNTSACTQACPKVTFDPIPIHYCSPAGYALLKCNDKMFNGTGPCSNVSTVQCTHGIKPVVSTQLLLNGSLAEEEIIIRSENLTNNVKTIIVHLNQSVEIICTRPGNNTRKSIRIGPGQTFYATGDIIGDIRQAHCNISRDKWNETLQRVSKKLAEHFPNKTIKFASSSGGDLEITTHSFNCRGEFFYCNTSGLFNGTYMHNGTQSNSSNSSSIITIPCRIKQIINMWQEVGRCMYAPPIAGNITCKSNITGLLLVRDGGETNQTNFTETFRPGGGDMRDNWRSELYKYKVVEIKPLGVAPTKCKRRVVGRRRRRRAVGGIGAVFLGFLGVAGSTMGAASITLTVQVRQLLSGIVQQQSNLLRAPEAQQHLLQLTVWGIKQLQTRVLAIERYLKDQQLLGIWGCSGKLICCTAVPWNSSWSNKSLTDIWENMTWMQWDKEISNYTNIIYRLLEDSQNQQEENEKDLLALD

SEQ ID NO: 1486 - protein, 626 aa, Artificial Sequence
  Recombinant HIV protein
AENLWATVYYGVPVWKEATTTLFCASDARAYDTEVHNIWATHACVPTDPNPQEVVLGNVTENFNMWINDMVEQMHEDIISLWDQSLKPCVKLTPLCVTLNCSNLNTTNTSSTIEGGEIKNCSFNITTSISTKVKDYAIFNKLDIVPIGNDTTSYILINCNTSVCTQACPKVSFEPIPIHYCTPAGFAILKCNNKTFQGTGPCTNVSTVQCTHGIRPVVSTQLLLNGSLAEEEVVIRSSNFSNNAKVIIVQLNKSVEINCTRPNNNTRKSISLGPGRAWYATGQIIGNIRQAHCNLSRTEWNNTLKQIVNKLREQYGNKTIIFNQSSGGDLEIVMHSFNCGGEFFYCNTSQLFNSTWNVTGTVNGTTGNGTITLPCSIKQIVNRWQEVGRCIYAPPIRGQIRCSSNITGLLLTRDGGNESTTTETETFRPAGGDMRDNWRSELYKYKVVKIEPLGVAPTKCKRRVVGRRRRRRAVGTIGAMFLGFLGAAGSTMGAASITLTVQARQLLSGIVQQQRNLLRAPEAQQHLLQLTVWGIKQLQARVLAVERYLKDQQLLGIWGCSGKLICCTTVPWNSSWSNKSLSEIWDNMTWMEWEREIANYTREIYTLIEESQNQQEKNELELLELD

SEQ ID NO: 1487 - protein, 631 aa, Artificial Sequence
  Recombinant HIV protein
AENLWVTVYYGVPVWKEATTTLFCASDAKAYDTEVHNIWATHACVPTDPNPQEVVLGNVTENFNMWKNDMVEQMHEDIISLWDQSLKPCVKLTPLCVTLNCTNLRNTNNTSSNTSNMTEGGEIKNCSFDITTSIRTKVKDYALFYELDIVAIDNTSYRLRQCNTSVCTQACPKISFEPIPIHYCTPAGFAILKCNNKTFNGTGPCTNVSTVQCTHRIRPVVSTQLLLNGSLAEEEVVIRSSNFTDNAKVIIVQLKESVEINCTRPNNNTRKSIPLGPGKAWYTTGQIIGDIRQAHCNLSRAKWENTLQQITKKLREQFGNKTIIFNQSSGGDPEVVTHSFNCGGEFFYCNTSQLFNSTWYNNSTWNDTNDTTENSTITLPCRIKQIVNMWQEVGKCMYAPPIRGQIRCSSNITGLLLTRDGGKNESNTTETFRPGGGDMRDNWRSELYKYKVVKIEPLGVAPTRCKRRVVGRRRRRRAVGTIGAMFLGFLGAAGSTMGAASITLTVQARQLLSGIVQQQRNLLRAPEAQQHLLQLTVWGIKQLQARVLAVERYLKDQQLLGIWGCSGKLICCTAVPWNVSWSNRSLSEIWDNMTWMEWEREIGNYTKQIYSLIEESQNQQEKNELELLEWD

SEQ ID NO: 1488 - protein, 628 aa, Artificial Sequence
  Recombinant HIV protein
AENLWVTVYYGVPVWKDATTTLFCASDAKAYDTEVHNVWATHACVPTDPNPQEVVLGNVTENFNMWKNNMVEQMHEDIISLWDQSLKPCVKLTPLCVTLNCANLGNTTNTSSNTSSTTEGGEIKNCSFNINTNIRTKVKDYALFYKLDVVPIDNDNTSYRLRHCNTSVCTQACPKVSFEPIPIHYCTPAGFAILKCNNKTFNGTGPCTNVSTVQCTHGIRPVASTQLLLNGSLAEEEVVIRSSNFTNNARVIIVQLNESVEINCIRPNNNTRKSIPLGQGRAWYTTGQIIGDIRQAHCNLSRTKWNDTLKQITEKLREQFGNKTIIFNQSSGGDPEIVMHSFNCGGEFFYCNTSQLFNSTWNASSTWNDTTENITLPCRIKQIVNMWQEVGKCMYAPPIRGQIRCSSNITGLLLTRDGGDNENTTTETFRPGGGDMRDNWRSELYKYKVVKIEPLGVAPTKCKRRVVGRRRRRRAVGTIGAMFLGFLGAAGSTMGAASITLTVQARQMLSGIVQQQRNLLRAPEAQQHLLQLTVWGIKQLQARVLAVERYLKDQQLLGIWGCSGKLICCTAVPWNVSWSNKSLGEIWNNMTWMEWEREIGNYTRQIYTLIEESQNQQEKNELELLELD

SEQ ID NO: 1489 - protein, 626 aa, Artificial Sequence
  Recombinant HIV protein
AENLWVTVYYGVPVWREAKTTLFCASDAKAYDTEVHNVWATHACVPTDPNPQEMDLENVTENFNMWKNEMVNQMHEDVISLWDQSLKPCVKLTPLCVTLECKDANATRNHTIANETQGEIKNCSFNATTEVKDKKQKVYALFYRLDIVPLNGKSDTYTYRLINCNTSACTQACPKVTFDPIPIHYCAPAGYAILKCKDKTFNGIGSCHNVSTVQCTHGIKPVVSTQLLLNGSLAESEIIIRSENLTDNVKTIIVHLNQSVEIVCTRPNNNTRKSIRIGPGQIFYATGDIIGDIRQAHCSINAGKWDETLQRVSERLKEHFPNKTIKFEPSSGGDLEITTHSFNCRGEFFYCNTSGLFNGTYNMTNGTSDNSTIIIPCRIKQIINMWQEVGRCMYAPPIEGNITCKSNITGLLLVRDGGNEDKNNTEIFRPGGGDMRDNWRSELYKYKVVEIKPLGIAPTECKRRVVGRRRRRRAVGIGAVFLGFLGAAGSTMGAASITLTVQARQLLSGIVQQQSNLLRAPEAQQHMLQLTVWGIKQLQTRVLAIERYLKDQQLLGIWGCSGKLICCTAVPWNSSWSNRSLSEIWDNMTWMQWDKEINNYTDTIYRLLEVSQTQQEQNEKDLLALD

SEQ ID NO: 1490 - protein, 644 aa, Artificial Sequence
  Recombinant HIV protein
AENLWVTVYYGVPVWRDADTTLFCASDAKAYDPEVHNVWATHACVPTDPNPQEIYLENVTENFNMWKNRMAEQMQEDVINLWDQSLKPCVKLTPLCVTLHCTNANLTKVINTTDPRISNETRKEIEKNNIADEVRNCSFNMTTVIRDKRQRVHALFYKLDIVPIVDDSGSNSSSEYRLINCNTSVCKQACPKMSFDPIPIHYCTPAGFAILRCNDKKFNGTGPCKNVSSVQCTHGIKPVVSTQLLLNGSLAEEEIIIRSEDLTNNAKTIIVHLNKSVEINCARPSNNTRTSIALGPGQAWYRTGDITGDIRKAYCEINRTRWKETLKQVAGKLKEHFNTSKIIFQPHSGGDLEITMHHFNCRGEFFYCNTTELFNSTWEENSNWTSTKIDTIKLPCKIKQIINMWQGVGQCMYAPPISGVINCLSNITGILLTRDGGNNSNANETFRPGGGDIKDNWRSELYKYKVVQIEPLGVAPTRCKRRVVGRRRRRRAVGIGTMIFGFLGAAGSTMGAASITLTVQARQLLSGIVQQQSNLLRAPNAQQHLLQLTVWGIKQLQARVLAVERYLKDQKFLGLWGCSGKIICCTAVPWNSTWSNKSYEQIWDNMTWIEWEREISNYTNQIYELLTESQNQQDRNEKDLLELD

SEQ ID NO: 1491 - protein, 653 aa, Artificial Sequence
  Recombinant HIV protein
AENLWVTVYYGVPVWKDAKTTLFCASDAKAYETEVHNVWATHACVPTDPNPQEIFMENVTEDFNMWKNDMVNQMHEDVISLWDQSLKPCVKLTPLCVTLECGNVSVSSNGTVASNKTYVEEMRNCSFNTTTFISDKHKKEHALFYRLDIVPLDDENSNKNCSKNSGQNCSEYYRLINCNTSACTQACPKVSFDPIPIHYCTPAGYALLKCNNKTFNGTGPCHNVSTVQCTHGIKPVVSTQLLLNGSLAEGEIIIRSENLTNNAKTIIVHLNQSVEIVCTRPNNNTRRSIRIGPGQTFFAHGEIIGDIRQAHCNISRNNWTETLQRVSRKLAEHFPNKTINFTSSSGGDLEITTHSFNCRGEFFYCNTSDLFNSTYMSNGTFRFNGTVFNGTGGDSSINITIPCRIKQIINMWQEVGRCMYAPPIAGNITCKSNITGLLLVRDGGTTNNTNNTEIFRPGGGDMRDNWRSELYKYKVVEVKPLGIAPTTCKRRVVGRRRRRRAVGLGAVFLGFLGAAGSTMGAASITLTVQARQLLSGIVQQQSNLLKAPEAQQHLLQLTVWGIKQLQTRVLAIERYLRDQQLLGIWGCSGKLICCTAVPWNSSWSNKSYNEIWENMTWMQWDKEVSNYTDTIYRLLEESQNQQERNEQDLLALD

SEQ ID NO: 1492 - protein, 638 aa, Artificial Sequence
  Recombinant HIV protein
AENLWVTVYYGVPVWKEAKTTLFCASDAKAYETEVHNIWATHACVPTDPNPQEIVMENVTENFNMWNNDMVDQMHEDVISLWDQGLKPCVKLTPLCVTLKCGNTTKSTTKHSFLNETYKGEIKNCSFNATTLLKDKQKTVYALFYRLDIVPLNDDKNSSDNSSGYYRLINCNTSACTQACPKVSFDPIPIHYCAPAGYAILQCNNKTFNGTGPCHNVSTVQCTHGITPVVSTQLLLNGSLAEGEIVIRSKNLTDNAKTIIVHLNESVEIVCTRPNNNTRKSIRIGPGQTFYATGDIIGNIRLAYCNISEEKWNKTLQRVSKKLAEHFPNKTIKFKASSGGDLEITTHSFNCRGEFFYCNTTRLFNGTYNSTTGTYNGITGSPNSTIIIPCRIKQIINMWQEVGRCIYAPPIEGNITCKSNITGILLVRDGGKTNKTEEIFRPEGGDMRDNWRSELYKYKVVEINPLGVAPTPCKRRVVGRRRRRRAVGIGAVFLGFLGAAGSTMGAASLTLTVQARQLLSGIAQQQSNLLRAPEAQQHMLQLTVWGIKQLQTRVLAIERYLKDQQLLGIWGCSGKLICCTAVPWNSSWSNKSQQEIWENMTWMQWDKEISNYTNTIYRLLEDSQNQQEKNEQDLLALD

SEQ ID NO: 1493 - protein, 646 aa, Artificial Sequence
  Recombinant HIV protein
AENLWVTVYYGVPVWKEATTTLFCASDAKAYDPEVHNIWATHACVPTDPNPQEVVLGNVTENFNMWKNDMVEQMQEDIISLWDQSLQPCVKLTPLCVNLTCTNATATNATATNSTVAPAPNSTAARTMTDYEMKNCSFNITTSTSTKMTGYAVFYNLDVVPIGKGNDTKSYRLLKCNTSVCTQACPKVSFEPIPLHYCAPAGFAILKCNNKTFSGTGPCTNVSTVQCTHGIRPVVSTQLLLNGSLAEEEVVIRSSNFSNNAKTIIVQLKEPVEINCTRPNNNTRKSMTLGPGRAWYTTGQIIGDIRKAHCNLSSTKWHDTLRQIAKKLSKQFGNKTVVFNQSSGGDPEIVMHSFNCGGEFFYCNTAQLFNSTWNTTKIWGNTTEGNNSTIMLPCKIKQIINLWQEVGKCIYAPPIAGRIRCVSNITGLLLTRDGGHNGNGSNETETFRPAGGDMRDNWRSELYKYKVVKIEPIGLAPTKCKRRVVGRRRRRRAMGIGAMFLGFLGAAGSTMGAASITLTVQARRLLSGIVQQQRNLLRAPEAQQHLLQLTVWGIKQLQARVLAVERYLKDQQLLGIWGCSGKLICCTAVPWNDSWSRNKTLKDIWNNMTWMQWEREIDNYTSEIYTLIEESQNQQEKNELELLELD

SEQ ID NO: 1494 - protein, 643 aa, Artificial Sequence
  Recombinant HIV protein
AENLWVTVYYGVPVWKEATTTLFCASDAKAYDTEVHNVWATHACVPADPNPQEMLLKNVTENFNMWKNEMVNQMHEDVISLWDQSLKPCVKLTPLCVTLNCTNVKINSTSNETCIDSGNNSTCNETYKEMRNCSFNATTVVRDKQQKMYALFYKLDIVPLNSGYKNSSDETYRLINCNTSACTQACPKVSFDPIPIHYCTPAGYALLKCNNKTFNGTGPCNNVSTVQCTHGIKPVVSTQLLLNGSLAEEEIIIRSENLTNNAKTIIVHLKEPVNITCERPNNNTRKSIRIGPGQTFYATGDIIGNIREAHCNISRSQWNKTLQGVGEKLAELFPNKTIVFKNSSGGDLEITTHSFNCRGEFFYCNTTDLFNSTYWSNGTYITQSNSSSINITLPCRIKQIINMWQEVGRCIYAPPIAGQITCISNITGLLLLRDGGKEANGTEIFRPGGGDMRDNWRSELYKYKVVEIKPLGVAPTKCKRRVVGRRRRRRAVGIGAVFLGFLGAAGSTMGAASITLTVQARQLLSGIVQQQSNLLKAPEAQQHLLQLTVWGIKQLQTRVLAIERYLKDQQLLGIWGCSGKLICCTAVPWNSSWSNKSQTEIWNNMTWMQWDREINNYTDIIYRLLEESQNQQENNEEDLLALD

SEQ ID NO: 1495 - protein, 636 aa, Artificial Sequence
  Recombinant HIV protein
AENLWVTVYYGVPVWRDADTTLFCASNAKAHSTEVHNVWATHACVPTDPNPQEIYLENVTENFNIWKNNMVEQMQEDIISLWDQSLQPCVKLTPLCVTLHCTTLNITNTTRNVTTPGPNLGNITDEVRNCSFNVTTEIRDKKHKVNALFYKLDIVQIENNNNNSNKYRLINCNTSVCKQACPKISFDPIPIHYCAPAGYAILKCNDKKFNGTGPCKNVSSVQCTHGIKPVVSTQLLLNGSLAEEEIIIRSENITDNAKTIIVHLNESVEINCTRPYNNTRKSITIGPGQVFYRQGEIIGDIRKAYCEINGTRWNTVLKKVKEKLKEHFNNTNITFQQPSGGDLEITTHHFNCRGEFFYCNTTKLFNNTCIEECNETICYNETTYLPCRIKQIINMWQGVGQCMYAPPIEGKISCVSNITGILLTRDGGNNNSTGNETFRPGGGNIKDNWRNELYKYKVVQIEPLGIAPTRCRRRVVGRRRRRRAVGIGAMIFGFLGAAGSTMGAASITLTVQARQLLSGIVQQQSNLLRAPEAQQHLLQLTVWGIKQLQARVLAVERYLKDQKFLGLWGCSGKIICCTAVPWNSSWSNKSYEEIWYNMTWIEWEREISNYTSQIYEILTESQNQQDKNEKDLLELD

SEQ ID NO: 1496 - protein, 630 aa, Artificial Sequence
  Recombinant HIV protein
AENLWVTVYYGVPVWKEAKTTLFCASDAKAHETEVHNVWATHACVPTDPSPQEIVMENVTEDFNMWNNDMVNQMHEDVISLWDQSLKPCVKLTPLCVTLECRNVSSNGTYNETYNEIKNCSFNATTLLRDKPKKVYALFYRLDIVPLNGENSSGKYRLINCNTSACTQACPKVSFDPIPIHYCTPAGYVILKCNDKTFDGTGQCHNVSTVQCTHGIKPVVSTQLLLNGSLAEEEIIIRSENLTNNAKTIIVHLNESVEIICTRPNNNTRKSIRIGPGQTFYATGDIIGDIRQAHCNISESRWSKTLYNVSKKLAEHFPKKTINFTSSSGGDLEITTHSFNCRGEFFYCNTSRLFNSTYNGTYMFNGIYNTTDNASSIITIPCRIKQIINMWQEVGRCMYAPPIEGNITCNSSITGLLLVRDGGSQPNNTETFRPGGGDMRDNWRSELYKYKVVEVKPLGVAPTECKRRVVGRRRRRRAVGLGAVFLGFLGAAGSTMGAASMTLTVQARQLLSGIVQQQSKLLRAPEAQQHLLQLTVWGIKQLQTRVLAIERYLKDQQLLGIWGCSGKLTCCTAVPWNSSWSNKSLSEIWDNMTWMQWDKEISNYTNTIYRLLEDSQSQQERNEKDLLALD

SEQ ID NO: 1497 - protein, 619 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVEIEPLGIAPTKCKRRVVGRRRRRRAVGIGAMIFGFLGAAGSTMGAASITLTVQARQLLSGIVQQQSNLLRAPEAQQHMLQLTVWGIKQLQARVLAVERYLKDQRFLGLWGCSGKTICCTAVPWNSTWSNKTYEEIWDNMTWTQWEREISNYTNQIYSILTESQSQQDKNEKDLLELD

SEQ ID NO: 1498 - protein, 629 aa, Artificial Sequence
  Recombinant HIV protein
AENLWVTVYYGVPVWRDADTTLFCASDAKAHSTEVHNIWATHACVPTDPNPQEIHMINVTESFNMWKNKMVEQMQEDVISLWDQSLQPCVKLTPLCVTLNCTKVKLTNFKETNDSNIGNITNEIANCTFNMTTELIDKTKQVYALFYKLDIVQIENNSNSSEYRLINCNTSVCKQACPKVSFDPIPIHYCTPAGYAILKCNDKKFNGTGPCKDVSSVQCTHGIKPVVSTQLLLNGSLAEEEIIIRSENLTNNAKTIIVHLNKSVEINCTRPSNHQRKRITMGPGRVYYSTGEITGDIRKAYCKINGTKWNETLKQVAKKLQEHFKNKTIIFKPPSGGDLEITMHHFICRGEFFYCNTTKLFNSTWKGNETMEGNNNTIIPCRIKQIVNMWQRVGQCMYNPPINGTINCVSNITGILLTRDGGDNTTDSETFRPGGGDIKDNWRSELYKYKVVEIEPLGIAPTKCKRRVVGRRRRRRAVGIGAMIFGFLGAAGSTMGAASITLTVQARQLLSGIVQQQSNLLRAPEAQQHLLQLTVWGIKQLQARVLAVERYLKDQKFLGLWGCSGKIICCTAVPWNPTWSNKSYEEIWDNMTWTEWEREISNYTNQIYEILTESQNQQDKNEKDLLELD

SEQ ID NO: 1499 - protein, 625 aa, Artificial Sequence
  Recombinant HIV protein
AENLWVTVYYGVPVWKEATTTLFCASDAKAYDAEVHNVWATHACVPTDPNPQEVVLGNVTETFDMWKNNMVEQMHEDIISLWDQSLKPCVKLTPLCVVLNCTNPTNTSSRTNSTTDMKNCSFDVTTNIQTKVKEYALFYKLDVIPIDDNNNISYRLRHCNTSVCTQACPKVSFEPIPIHYCAPAGFAIIKCNNKMFNGTGPCTNVSTVQCTHGIRPVVSTQLLLNGSLAEEEVVIRSRNFTDNARVIIVQLNDSVEINCTRPNNNTRKRVTLGPGRVWYTTGQIIGDIRKAHCNLSIAKWNNTLKKITEKLKEQFGNKTIIFKQPSGGDLEVVMHSFNCGGEFFYCNTSQLFNETWTWNNSTRNDNTGNGTITLPCRIKQIVNMWQEVGKCMYAPPIRGQIRCSSNITGLLLTRDGGNNTDKNTEIFRPGGGNMRDNWRSELYKYKVVKIEPLGVAPTKCKRRVVGRRRRRRAVGIGAVFLGFLGAAGSTMGAASITLTVQARQLLSGIVQQQRNLLMAPEAQQHLLQLTVWGIKQLQARVLAVERYLKDQQLLGIWGCSGKLICCTAVPWNTSWSNKSLSQIWDNMTWMEWEREIDNYTREIYTLIEQSQNQQEKNELELLELD

SEQ ID NO: 1500 - protein, 650 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVEIKPLGVAPTECKRRVVGRRRRRRAVGIGAVFLGFLGAAGSTMGAASITLTVQARQLLSGIVQQQSNLLRAPEAQQHMLQLTVWGIKQLQTRVLAIERYLKDQQLLGIWGCSGKLICCTAVPWNSSWSNKSHEEIWNNMTWMQWDREISNYTNIIYNLLEESQNQQERNEKDLLALD

SEQ ID NO: 1501 - protein, 634 aa, Artificial Sequence
  Recombinant HIV protein
AENLWVTVYYGVPVWRDAETTLFCASDAKAHETEVHNVWATHACVPTDPNPQEIFLKNVTENFNMWRNNMVEQMQEDVVSLWDQSLKPCVKLTPLCVTLKCSNANLTKANLTTVSNIGNITDEIRNCSFNMTTELRDKRQNVYALFYKLDIVQLNENSNNSDEYRLINCNTSVCKQACPKVSFDPIPIHYCTPAGYAILKCNDKNFNGTGPCRNVSSVQCTHGIKPVVSTQLLLNGSLAEEEIIIRSENLTNNAKTIIVHLNKSVEINCIRPSTNTRTSVRIGPGQVFYRTGDIIGDIRKAYCEINGTKWNETLTQVAGKLREHFNTTIIFQPPSGGDLEITMLHFNCRGEFFYCNTSQLFNSTWNNTGENNTMERGNGTDTIILPCKIKQIINMWQGVGQCMYAPPISGNISCVSNITGILLTRDGGNNMTNETFRPGGGNIKDNWRSELYKYKVVQIEPLGVAPTKCRRRVVGRRRRRRAVGIGALLFGFLGAAGSTMGAASITLTVQARQLLSGIVQQQSNLLRAPEAQQHLLQLTVWGIKQLQARVLAVERYLEDQKFLGLWGCSGKIICCTNVPWNSTWSNRSYEEIWDNMTWIEWEREISNYTNQIYEILTESQNQQDKNEKDLLELD

SEQ ID NO: 1502 - protein, 635 aa, Artificial Sequence
  Recombinant HIV protein
AENLWVTVYYGVPVWKEANTNLFCASDAKAYETEVHNVWATHACVPTDPNPQEVFLENVTENFNMWKNNMVEQMHEDIISLWDQSLKPCVKLTPLCVTLNCTNVTTNGTSTNVTDVQEMKNCSFNATTEVRDRKHKEYALFYRLDIVPLDKENSSSKENSSSEYYRLINCNTSACTQACPKVTFDPIPIHYCTPAGHAILKCNDKTFNGTGPCPNVSTVQCTHGIKPVVSTQLLLNGSLAENITIRSEDLANNVKTIIVHLDQAVEIVCTRPNNNTRKSIRIGPGQTFYATGKIIGNIREAHCNISKWNETLLRVSKKLAEHFPNRTIKFEPSSGGDLEITTHSFNCRGEFFYCNTSQLFNSIYQPNDTYMHNGAGNNSDITIPCRIKQIINMWQEVGRCMYAPPVEGNITCKSNITGLLLLRDGGINGTNNTEIFRPGGGDMRDNWRNELYKYKVVKIEPLGVAPSRCKRRVVGRRRRRRAVGTIGAMFLGFLGAAGSTMGAASVTLTVQARQLLSGIVQQQRNLLRAPEAQQHMLQLTVWGIKQLQARVLAVERYLKDQQLLGIWGCSGKLICCTAVPWNTSWSNKSMNEIWDNMTWMQWEREINNYTKEIYTLIEESQNQQEKNELELLELD

SEQ ID NO: 1503 - protein, 644 aa, Artificial Sequence
  Recombinant HIV protein
AENLWVTVYYGVPVWRNAETTLFCASDAKAYDAEAHNVWATHACVPTDPNPQEIHLKNVTEKFNMWKNNMVEQMHEDIISLWDQSLKPCVKLTPLCVTLDCHNVNSSNSSTSNSSNSSTPINRTIDSDMQEEIKNCSFNMTTELRDKKQKVSALFYRLDVVQINESSNSQYRLINCNTSACTKACPKVTFEPIPIHYCAPAGFAILKCNDKKFNGTGLCKNVSTVQCTHGIKPVVSTQLLLNGSLAEEEVVIRSEDITNNAKNIIVQLVAPVRINCTRPNNNTRRSVRIGPGQTFYATGDIIGDIRQAHCNVSRSEWNRTLQQVAAQLRKHFNKTIIFANSSGGDIEITTHSFNCGGEFFYCNTSELFNSTWNSTWDNSSNHIESNHTEGNITLQCRIKQIVNMWQKVGLCMYAPPISGEIRCKSNITGLLLTRDGGSNNSTNETFRPGGGDMRDNWRSELYKYKVVKIEPLGVAPTRCKRRVVGRRRRRRAVGLGAVFLGFLGAAGSTMGAASITLTVQARQLLSGIVQQQSNLLRAPEAQQHLLKLTVWGIKQLQARVLALESYLRDQQLLGIWGCSGKLICCTNVPWNSSWSNKTYNDIWDNMTWLQWDKEVSNYTDIIYNLIEESQNQQEKNEQDLLALD

SEQ ID NO: 1504 - protein, 628 aa, Artificial Sequence
  Recombinant HIV protein
AENLWVTVYYGVPVWTEAKTTLFCASDAKAYEREVHNVWATHACVPTDPNPQEIVLGNVTENFNMWKNDMVDQMHEDIISIWDQSLKPCVKLTPLCVTLNCTDVKVNATSNGTTTYNNSIDSMNGEIKNCSFNITTEIRDKKQKVYALFYRPDVVPLNENSSSYILINCNTSTCTQACPKVSFDPIPIHYCAPAGYAILKCNNKTFNGTGPCHNVSTVQCTHGIKPVVSTQLLLNGSLAEEEIIIRSENLTNNAKTIIVHLNESIEIVCTRPNNNTRKSIRIGPGQTVYATNDIIGDIRQAHCNISKTKWNTTLEKVKEKLKEHFPSKAITFQPHSGGDLEVTTHSFNCRGEFFYCDTTKLFNESNLNTTNTTTLTLPCRIKQIVNMWQGVGRCMYAPPVEGNITCNSSITGLLLVRDGGNTSNSTPEIFRPGGGNMKDNWRSELYKYKVVEIKPLGVAPTKCKRRVVGRRRRRRAVGIGAVLFGFLGAAGSTMGAASITLTVQARQLLSGIVQQQSNLLRAPEAQQHMLQLTVWGIKQLQARVLAIERYLKDQQLLGLWGCSGKLICCTTVPWNSSWSNKSQTDIWDNMTWMQWDREISNYTGTIYKLLEESQNQQEKNEKDLLALD

SEQ ID NO: 1505 - protein, 616 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCTNAPAYNNSMHGEMKNCSFNTTTEIRDRKQKAYALFYKPDVVPLNRREENNGTGEYILINCNSSTCTQACPKVTFDPIPIHYCAPAGYAILKCNNKTFNGTGPCNNVSTVQCTHGINPVVSTQLLLNGSLAEEEIIIRSENLTNNIKTIIVHLNKSVEIVCTRPNNNTRRSIRIGPGQTFYATGEIIGNIREAHCNISKSSWTSTLEQVKKKLKEHYNKTIEFNPPSGGDLEVTTHSFNCRGEFFYCNTTKLFSNNSDSNNETITLPCKIKQIINMWQKVGRCMYAPPIEGNITCKSNITGLLLTRDGGKNTTNEIFRPGGGNMKDNWRSELYKYKVVEIEPLGVAPTKCKRRVVGRRRRRRAVGLGAVLLGFLGAAGSTMGAASITLTVQARQLLSGIVQQQSNLLRAPEAQQHMLQLTVWGIKQLQTRVLAIERYLKDQQLLGLWGCSGKIICCTAVPWNSSWSNKSQEDIWDNMTWMQWDREISNYTGTIYRLLEDSQNQQEKNEKDLLALD

SEQ ID NO: 1506 - protein, 631 aa, Artificial Sequence; identical to SEQ ID NO: 1061
  Recombinant HIV protein

SEQ ID NO: 1507 - protein, 634 aa, Artificial Sequence
  Recombinant HIV protein
AENLWVTVYYGVPVWKEAKTTLFCASDAKAHKEEVHNIWATHACVPTDPNPQEIVLKNVTENFNMWKNDMVDQMHEDIISLWDQSLKPCVKLTPLCVTLNCSDVKIKGTNATYNNATYNNNNTISDMKNCSFNTTTEITDKKKKEYALFYKLDVVALDGKETNSTNSSEYRLINCNTSACTQACPKVSFDPIPIHYCAPAGYAILKCNNKTFNGTGPCNNVSTVQCTHGIKPVVSTQLLLNGSLAEEEVVIRFENLTNNAKIIIVHLNESVEINCTRPSNNTRKSVRIGPGQTFFATGDIIGDIRQAHCNISRKKWNTTLQRVKEKLKEKFPNKTIQFAPSSGGDLEITTHSFNCRGEFFYCYTSDLFNSTYMSNNTGGANITLQCRIKQIIRMWQGVGQCMYAPPIAGNITCKSNITGLLLTRDGGKEKNDTETFRPGGGDMRDNWRSELYKYKVVEIKPLGIAPDKCKRRVVGRRRRRRAVGIGAVFLGFLGAAGSTMGAASMTLTVQARQLLSGIVQQQSNLLRAPEAQQHMLQLTVWGIKQLQTRVLAIERYLKDQQLLGIWGCSGKLICCTAVPWNASWSNKSYEEIWGNMTWMQWDREINNYTNTIYSLLEESQNQQEKNEKDLLALD

SEQ ID NO: 1508 - protein, 630 aa, Artificial Sequence; identical to SEQ ID NO: 1062
  Recombinant HIV protein

SEQ ID NO: 1509 - protein, 625 aa, Artificial Sequence
  Recombinant HIV protein
AENLWVTVYYGVPVWKEAITTLFCASDAKAYKTEAHNIWATHACVPTDPNPQEVILENVTENFNMWKNNMVDQMHEDIISLWDQSLKPCVKLTPLCVTLKCTNVNSTTSTNSSEEGIGEMKNCSFNITTSVKDKVQKEYALFYRLDIVPIDNTSYRLVKCNTSVCTQACPKVSFEPIPIHYCAPAGFAILKCRDKKFNGTGPCKNVSTVQCTHGIRPTVSTHLLLNGSLAEEEVVIRSENFTKNEKTIIVQLNQSVEITCIRPYNNTRKSIHMGPGRAFYATGEIIGDIRKAHCNVNKTKWHEALKKIAKKLEEQYNNNKTISFNQSTGGDPETAMFTFNCGGEFFYCNSSQLFNSTSKQLFNSTWNNTNANIELPCRIRQIVNMWQRIGKCMYAPPISGQINCTSNITGLLLTRDGDKNNKSTEVFRPIGGEMRDNWRSELYKYKVVQIEPLGVAPTRCKRRVVGRRRRRRAVGIGAVFLGFLGAAGSTMGAAAVTLTVQARLLLSGIVQQQSNLLRAPEAQQHLLQLTVWGIKQLQARVLAVERYLQDQQLLGIWGCSGKLICCTSVPWNASWSNKSMSEIWENMTWMEWEKEISNYTGLIYNLIEKSQNQQEQNEQELLALD

SEQ ID NO: 1510 - protein, 656 aa, Artificial Sequence
  Recombinant HIV protein
AENLWVTVYYGVPVWKEATTTLFCASDAKAYETEVHNVWATHACVPTDPNPQEVLLENVTENFNMWKNNMVEQMQEDIISLWDQSLKPCVKLTPLCVTLECHDVNVNGTANNGTTNVTESGVNSSDVTSNNVTNSNWGTMEKGEIKNCSFNITTNIRDKMQKETAQFYKLDIVPIEDQNKTNNTLYRLINCNTSVCTQACPKVSFEPIPIHYCTPAGFAILKCNDRNFNGTGPCKNVSTVQCTHGIKPVVSTQLLLNGSLAEAEVVIRSENFTNNAKTIIIQLNETVEINCTRPNNNTSKRISIGPGRAFRATKIIGNIRQAHCNISRATWNSTLKKIVAKLREQFGNKTIVFQPSSGGDPEIVMHSFNCGGEFFYCNTTQLFNSTWNSTEESNSTEEGTITLPCRIKQIINMWQEVGKCMYAPPIEGQIRCSSNITGLLLTRDGGNNNKTNGTEIFRPGGGDMRDNWRSELYKYKVVKIEPLGVAPTKCKRRVVGRRRRRRAVGIVGAMFLGFLGAAGSTMGAASMTLTVQARLLLSGIVQQQNNLLRAPEAQQHLLQLTVWGIKQLQARVLAVERYLKDQQLLGIWGCSGKLICCTTVPWNTSWSNKSLSEIWDNMTWMQWEREIDNYTSLIYTLIEESQNQQEKNEQELLELD

SEQ ID NO: 1511 - protein, 629 aa, Artificial Sequence; identical to SEQ ID NO: 1063
  Recombinant HIV protein

SEQ ID NO: 1512 - protein, 628 aa, Artificial Sequence; identical to SEQ ID NO: 1064
  Recombinant HIV protein

SEQ ID NO: 1513 - protein, 638 aa, Artificial Sequence
  Recombinant HIV protein
AENLWVTVYYGVPVWKDAETTLFCASDAKAYETEKHNVWATHACVPTDPSPQEIPLKNVTEKFNMWKNNMVEQMHTDIISLWDQSLKPCVQLTPLCVTLNCSDVTTNNTKVNTTSAPTTTATVNNDNDMKNCSYNITTELRDKKQKRYSLFYRLDVELINKNNSNSTEYVLINCKTSTCTQACPKVSFEPIPKHYCAPAGFAILKCKDKEFNGTGLCKNVSTVQCTHGIKPVVSTQLLLNGSLVEKRVMIRSANITDNTKNIIVQLKEPVEINCTRPNNNTRKGVHIGLGRRFYTTQVVGDIRQAYCNVSKSKWNDTLKKVVYQLRKYFNKTIIFNSSSGGDVEITTHMFTCGGEFFYCNTSGLFNSTWPVNASEQESNSTESDGIITLRCRIKQIINMWQRTGQCMYAPPIQGIIKCVSNITGLLLTRDGGNSTVNETFRPGGGDMRDNWRSELYKYKVVKIEPLGVAPTKCRRRVVGRRRRRRAVGIGAVFLGFLGAAGSTMGAASITLTVQARQLLSGIVQQQNNLLRAPEAQQQLLKLTVWGIKQLQARVLAVERYLRDQQLLGIWGCSEKLICCTNAPWNSSWSNKSQSEIWDNMTWLQWDREINNYTDIIYRLLEDSQNQQEKNEQDLLALD

SEQ ID NO: 1514 - protein, 631 aa, Artificial Sequence; identical to SEQ ID NO: 1065
  Recombinant HIV protein

SEQ ID NO: 1515 - protein, 634 aa, Artificial Sequence
  Recombinant HIV protein
AENLWVTVYYGVPVWKDAETTLFCASDAKAYATEKHNVWATHACVPTDPNPQEIHLENVTEEFNMWKNNMVEQMHTDIISLWDQSLKPCVKLTPLCVTLNCSNANVRYSNATVNNTIKDEIKNCSFNTTTALRDKRQKVYSLFYRLDIVQIDNSSSDSSSSEYRLINCNTSACTQACPKVTFEPIPIHYCAPAGFAILKCKDEEFNGTGPCKNVSTVQCTHGIKPVVSTQLLLNGSLAKREVKIRTENITNNAKNIIVQFVNPVEINCTRPNNNTRKSIHIGPGQAFYATGDIIGDIRQAHCNVSRSSWNKTLQQVAKQLGTYFKNKTIVFNTSSGGDPEITTHSFNCAGEFFYCDTSGLFNSSWNNNTWKESNSTGSNDTITLLCRIKQIINMWQRTGQCMYAPPIPGLISCKSNITGIILTRDGGNGNSTNETFRPGGGDMRDNWRSELYRYKVVQIEPLGVAPTRCRRRVVGRRRRRRAVGIGAVFLGFLGAAGSTMGAASITLTVQARQLLSGIVQQQSNLLRAPEAQQHLLKLTVWGIKQLQARVLAVERYLRDQQLLGIWGCSGKLICCTNVPWNSSWSNKSYNDIWDNMTWLQWDKEIHNYTQLIYNLIEESQNQQEKNEQDLLALD

SEQ ID NO: 1516 - protein, 630 aa, Artificial Sequence
  Recombinant HIV protein
AENLWVTVYYGVPVWKDANTTLFCASDAKAHETEVHNIWATHACVPTDPNPQEMYLANVTENFNMWKNNMAEQMQEDVISLWDQSLKPCVKLTPLCVTLNCTNDISTNGTYNSSDIIGNITDEVRNCSFNMTTELIDKKQKVHALFYKLDIVQIEDDNSNRSMYRLINCNTSVCKQACPKVSFDPIPIHYCTPAGYVILKCNEKNFNGTGPCKNVSSVQCTHGIKPVVSTQLLLNGSLAEDEIIIRSENLTNNAKTIIVHLNESVEINCTRPYNTKIKVTRGPGRVYYRTGEITGDIRKAYCKINGTEWYKTLKQVAGKLREHFNNKTIIFQPPSGGDLEVTMHHFNCRGEFFYCNTTQLFNKTYRGNETMERSNGTIILPCKIKQIINMWQETGQCMYAPPINGEINCISNITGILLTRDGGINRTYNETFRPGGGNMKDNWRNELYKYKVVQIEPLGVAPTRCKRRVVGRRRRRRAVGIGIMIFGFLGAAGSTMGAASITLTVQARQLLSGIVQQQSNLLRAPEAQQHLLQLTVWGIKQLQARVLAVERYLKDQKFLGLWGCSGKIICCTAVPWNSTWSNRSLEEIWDNMTWIEWEREISNYTSQIYEILTESQNQQDRNEKDLLELD

SEQ ID NO: 1517 - protein, 629 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVEIEPLGVAPTRCKRRVVGRRRRRRAVGIGAVFLGFLGAAGSTMGATSITLTVQARQLLSGIVQQQNNLLRAPEAQQHLLKLTVWGIKQLQARVLAVERYLRDQQLLGIWGCSGKLICCTNVPWNSSWSNKSLDEIWNNMTWLQWDKEINNYTQLIYRLIEESQNQQEKNEKELLELD

SEQ ID NO: 1518 - protein, 640 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLNCSNANVTSENSTIMGDREEIKNCSFNMTTELRDKRQKVYSLFYRLDVVQINENQGNSSNNNYSEYRLINCNTSACTQACPKVSFEPIPIHYCAPAGFAILKCKDEEFNGTGPCKNVSTVQCTHGIKPVVSTQLLLNGSTAEKEIKIRSENITNNAKIIIVQLVKPVIINCTRPNNNTRRSVHIGPGQAFYATGDIIGNIRQAYCTVNRTDWNNTLQQVAKQLGKHFENKTIIFTKSSGGDLEITTHSFNCGGEFFYCNTSSLFNSTWSHNNSTLLGSNSTESNETITLPCRIKQIVNMWQRTGQCMYAPPIKGVIMCVSNITGLILTRDGGNDNSTNENETFRPGGGDMRDNWRSELYKYKVVEIEPLGVAPTRCKRRVVGRRRRRRAVGIGAVFLGFLGAAGSTMGATSITLTVQARQLLSGIVQQQNNLLRAPEAQQHLLKLTVWGIKQLQARVLAVERYLRDQQLLGIWGCSGKLICCTNVPWNSSWSNKSLDEIWNNMTWLQWDKEINNYTQLIYRLIEESQNQQEKNEKELLELD

SEQ ID NO: 1519 - protein, 649 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNEGNGTAGGEGSNDTVTNREEIKNCSFNMTTELRDKKQRVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAKKEVKIRSENITNNVKTIIVQLVNPVIINCTRPNNNTRKSIRIGPGQSFYAAGAIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIKQIINMWQRTGQCMYAPPIPGVISCVSNITGLLLTRDGGGNNNTNETFRPGGGDMRDNWRSELYKYKVVEIEPLGVAPTRCKRRVVGRRRRRRAVGIGAVFLGFLGAAGSTMGATSITLTVQARQLLSGIVQQQNNLLRAPEAQQHLLKLTVWGIKQLQARVLAVERYLRDQQLLGIWGCSGKLICCTNVPWNSSWSNKSLDEIWNNMTWLQWDKEINNYTQLIYRLIEESQNQQEKNEKELLELD

SEQ ID NO: 1520 - protein, 638 aa, Artificial Sequence
  Recombinant HIV protein
AENLWVTVYYGVPVWKEATTTLFCASDAKAYDTEVHNVWATHACVPTDPNPQEVELVNVTENFNMWKNNMVEQMHEDIISLWDQSLKPCVKLTPLCVTLNCTDLRNTTNTNNNTDNNNSKSEGTIKGGEMKNCSFNITTSIGDKMQKEYALLYKLDIVSIDNDSTSYRLISCNTSVCTQACPKISFEPIPIHYCAPAGFAILKCNDKKFSGKGSCKNVSTVQCTHGIRPVVSTQLLLNGSLAEEEVVIRSENFTDNAKTIIVHLNESVQINCTRPNYNKRKRIHIGPGRAFYTTKNIKGTIRQAHCNISRAKWNDTLRQIVSKLKEQFKNKTIVFNPSSGGDPEIVMHSFNCGGEFFYCNTSPLFNSTWNSNNTWNNTTGSNNNITLQCKIKQIINMWQKVGKCMYAPPIEGQIRCSSNITGLLLTRDGGEDTDTNDTEIFRPGGGDMRDNWRSELYKYKVVTIEPLGVAPTKCKRRVVGRRRRRRAAIGALFLGFLGAAGSTMGAASVTLTVQARLLLSGIVQQQNNLLRAPEAQQHMLQLTAWGIKQLQARVQAVERYLKDQQLLGFWGCSGKLICCTTVPWNASWSNKSLDDIWNNMTWMQWEREIDNYTSLIYSLLEKSQTQQEKNEQELLELD

SEQ ID NO: 1521 - protein, 625 aa, Artificial Sequence
  Recombinant HIV protein
AENLWVTVYYGVPVWKDAETTLFCASDAKAYETEKHNVWATHACVPTDPNPQEMDLENVIEEFNMWKNNMVEQMHTDIISLWDQSLKPCVKLTPLCVTLDCINHRIINNTNGTIDMGDEIKNCSFNMTTELRDKKQKVYSLFYKLDVVPLDEANGNNNNSYRLVNCNTSACTQACPKVTFEPIPIHYCAPAGFAILKCKDKEFSGTGPCENVSTVQCTHGIKPVVSTQLLLNGSLAEEHVMIRSENITNNAKNILVQLNESVEIYCIRPSNNTRKSVRIGPGQTFYATGEIMGDIRQAHCNVSGSEWNKTLQQVADQLRKHFNTTTIIFANPSGGDLEITTHSFNCGGEFFYCNTSGLFNSTWPSSTQESSDPITLQCRIKQIINMWQRVGQCMYVPPIQGEIRCNSSITGIILTRDGGPNTTNETFRPGGGDMRDNWRSELYKYKVVKIEPLGVAPTKCRRRVVGRRRRRRAVTMGAVFLGFLGAAGSTMGAASLTLTVQARLLLSGIVQQQSNLLRAPEAQQHLLKLTVWGIKQLQARVLAVERYLRDQQLLGIWGCSGKLICCTNVPWNSSWSNKSYSEIWDNMTWLQWDKEVSNYTDIIYKLLEDSQNQQEKNEQDLLALD

SEQ ID NO: 1522 - protein, 627 aa, Artificial Sequence
  Recombinant HIV protein
AENLWVTIYYGVPVWKEAKTTLFCASEAKAYEKEVHNVWATHACVPTDPNPQEMVLENVTENFNMWKNDMVNQMHEDIISLWDQSLKPCVKLTPLCVTLNCTNANGTNNNGTVNVNDTMYGEIKNCSFNMTTELRDKKKQVYALFYKLDIVSLNENSNNSSEYRLINCNTSVCTQACPKVTFDPIPIHYCAPAGYAILKCNNKTFTGIGPCKNVSTVQCTHGIKPVVSTQLLLNGSLAEEEIIVRSENLTDNVKTIIVHLNESVEIVCTRPNNNTRKSVRIGPGQTFYATGAIIGDIRQAHCNISTIKWNKTLQGVEKKLKEHFPNKTIEFKPSSGGDLEITTHSFNCRGEFFCCNTSNLFTSNLFTDNLTNTTNITLPCRIKQIINMWQGVGRCMYAPPIAGNITCKSNITGLLLTRDGGENNRTETFRPGGGDMKDNWRSELYKYKVVEIKPLGVAPTGCNRRVVGRRRRRRAVGIGAVFLGFLGAAGSTMGAASITLTVQARQLLSGIVQQQSNLLRAPEAQQHMLQLTVWGIKQLQARVLAIERYLRDQQLLGMWGCSGKLICCTAVPWNSSWSNKTYNDIWNNMTWMQWDREISNYTDTIYRLLEDSQNQQERNEKDLLALD

SEQ ID NO: 1523 - protein, 647 aa, Artificial Sequence
  Recombinant HIV protein
AENLWVTVYYGVPVWKEATTTLFCASDAKSYEAEAHNIWATHACVPTDPNPREIKLENVTEHFNMWKNNMVEQMHKDIISLWDQSLKPCVKLTPLCVTLNCTDVKNETIAKTFNKNKTMKNETMKNLNDTIKNLNETMTNCSFRVTTELRDKEKQVHALFYRLDVVKTDGGNNSYRLINCNTSVCTQACPKITFEPIPIHYCAPAGFAILKCNNKTFNGTGPCKNVSTVQCTHGIKPVVSTQLLLNGSLAEEETIIRSENITNNAKTIIVQLNESVTINCTRPSNNTRQSIRIGPGQAFYTTEVIGNIRLAFCEINGTEWNKTLQQVAKKLGNLFSNKTIIFKPSSGGDLEITTHSFNCRGEFFYCNTSKLFNSTWDNDTWSDTTNSTGGNASKIILPCRIKQIINMWQEVGKCMYAPPIRGAINCLSNVTGLLLTRDGGNTNSTNETFRPGGGDMRDNWRSELYKYKVVRIEPLGLAPTECKRRVVGRRRRRRAIGLGALFLGFLGAAGSTMGAASMTLTVQARQVLSGIVQQQNNLLKAPEAQQHMLQLTVWGIKQLQARILAVERYLKDQQLLGIWGCSGKHICCTNVPWNASWSNKSLEAIWKNMTWMEWEREIDNYTELIYNLLEESQIQQEKNEQELLQLD

SEQ ID NO: 1524 - protein, 647 aa, Artificial Sequence; identical to SEQ ID NO: 1066
  Recombinant HIV protein

SEQ ID NO: 1525 - protein, 621 aa, Artificial Sequence; identical to SEQ ID NO: 1067
  Recombinant HIV protein

SEQ ID NO: 1526 - protein, 627 aa, Artificial Sequence; identical to SEQ ID NO: 1068
  Recombinant HIV protein

SEQ ID NO: 1527 - protein, 621 aa, Artificial Sequence
  Recombinant HIV protein
AENLWVVYYGVPVWKDAETTLFCASNAKAYGTEVNIWATHACVPTDPNPQEINLENVTEEFNMWKNNMVEQMHTDIISLWDQGLKPCVKLTPLCVTLDCYNVTKSDKITKDMQEEIKNCSFNITTELRDKKQKVHSLFYRLDVVPMGGKNDSQYRLINCNTSACTQACPKVTFEPIPIHYCAPAGFAILKCNDKEFSGTGPCKNVSSVQCTHGIRPVVSTQLLLNGSLAEEKVRIRSEDITNNGKNIIVQLKTPVNISCTRPNNNTRKSVRIGPGQAFYATDDIIGNIRQAYCTVNRTQWDYTLQEVANQLRIYFNKTIIFNNSAGGDLEITTHSFNCGGEFFYCDTSGLFNSTWTWNDTVSWQGSDNITLQCRIKQIINMWQRAGQCIYAPPIQGVIRCDSNITGLILTRDGGNNSSPNEIFRPGGGDMRDNWRSELYKYKVVKIEPLGVAPTRCKRRVVGRRRRRRAVGIGAVFIGFLGAAGSTMGAASITLTAQARKLLSGIVQQQSNLLRAPEAQQHLLKLTVWGIKQLQARVLAVERYLKDQQLLGIWGCSGKLICCTNVPWNSSWSNKSQSEIWENMTWLQWDKEINNYTQLIYSLIEKSQTQQEINEQDLLALD

SEQ ID NO: 1528 - protein, 640 aa, Artificial Sequence
  Recombinant HIV protein
AENLWVTVYYGVPVWKDAETTLFCASDAKAYETEKHNVWATHACVPTDPNPQEIRLENVTEDFNMWKNSMVEQMNEDIISLWDQSLKPCVKLTPLCVTLNCTDWTNNATSTNQTTPATSEETGVKNCSFNITTELRDKKQKVYSLFYKLDVVQISENNSSNSSNFTQYRLINCNTSACTQACPKVSFEPIPIHYCAPAGFAILKCNDSVFNGTGPCKNVSTVQCTHGIKPVVSTQLLNGSLAERKVMIRSENITNNAKNIIVQFTKPVNITCIRPGNNTRKSVRIGPGQAFYATGDITGDIRNAHCVVNRTEWNNTLQKVVEQLREYFPNKTIIFTNSSGGDIEITTHSFNCGGEFFYCNTSKLFNSRWENNGTANMLKNDTGSNETTLILRCRIKQIINMWQRVGQCMYAPPIQGVINCTSNITGLILTRDGGGENDTETFRPGGGDMRDNWRSELYKYKVVKLEPLGVAPTMCKRRVVGRRRRRRAVGMAAVFLGFLGTAGSTMGAASLTLTVQARQLLSGIVQQQSNLLKAPEAQQHLLRLTVWGIKQLQARVLAVERYLKDQQLLGIWGCSGKLICCTSVPWNSSWSNKTQQEIWNNTTWLQWDKEISNYTGTIYRLLEESQNQQEKNEQDLLALD

SEQ ID NO: 1529 - protein, 632 aa, Artificial Sequence
  Recombinant HIV protein
AENLWVTVYYGVPVWRDAETTLFCASDAKAYDREAHNVWATHACVPTDPSPQEVPLGNVTEEFNMWKNNMVEQMHTDIISLWDQSLQPCVKLTPLCVTLNCSNSNNIPSVSNITDDMKEEIKNCSFNMTTELKDKKQNVYSLFYRLDVVPLETKTNQNSSHSRYRLINCNTSACTQACPKVSFEPIPIHYCAPAGFAILKCNDKGFNGTGLCKNVSTVQCTHGIKPVVSTQLLLNGSLAEGKVMVRSENITNNAKNIIIQFNNSVQINCTRPGNNTRKSIHLGPGKVFYATDIIGDIRKAHCNVNRQQWNKTLQDVATQLRTHFRNRTIIFNNSLGGDLEITTHSFNCRGEFFYCNTSGLFNGIWNGTQEPNRTESNDTITLQCRIKQIINMWQRVGQCIYAPPIQGEIRCESNITGLILTRDGGIINSTEETFRPGGGDMRDNWRSELYKYKVVKIEPLGVAPTKCKRRVVGRRRRRRAVGFGAFFLGFLGAAGSTMGAASITLTVQARQLLSGIVQQQNNLLRAPEAQQHLLKLTVWGIKQLQARVLAVERYLKDQQLLGIWGCSGKFICCTTVPWNSSWSNKSQSEIWDNMTWMQWDKEINNYTQIIYDLIEESQRQQEKNEQDLLALD

SEQ ID NO: 1530 - protein, 639 aa, Artificial Sequence; identical to SEQ ID NO: 1069
  Recombinant HIV protein

SEQ ID NO: 1531 - protein, 626 aa, Artificial Sequence
  Recombinant HIV protein
AENLWVTVYYGVPVWKEAETTLFCASDAKAYETEKHNVWATHACVPTDPNPQEIHLENVTEEFNMWKNNMVEQMHTDIISLWDQSLKPCVKLTPLCVTLDCNNVTNNGTSDMREEIKNCSFNMTTELRDKRQKVYSLFYKLDIVQINEDQGNSSNNKYRLITCNTSACTQACPKVTFEPIPIHYCAPAGFAILKCKDEEFNGIGPCKNVSTVQCTHGIKPVVSTQLLLNGSLAEKEVKIRCENITNNAKTIIVQLVNPVKINCTRPNNNTRKSIHIGPGQAFYATGDIIGDIRQAHCNVNRTEWNNTLHQVVEQLRKHFNKTINFANSTGGDLEITTHSFNCGGEFFYCNTTNLFNSTWNHTASMNSTESNDTIILPCRIKQIINMWQRVGQCMYAPPIRGVIRCESNITGLILTRDGGNTNSTRETFRPGGGDMRDNWRSELYKYKVVKIEPLGVAPTKCKRRVVGRRRRRRAVGIGAVFIGFLGAAGSTMGAASITLTVQARQLLSGIVQQQSNLLRAPEAQQHLLKLTVWGIKQLQARVLAVERYLKDQQLLGIWGCSGKLICCTSVPWNSSWSNKSQNEIWDNMTWLQWDKEISNYTQIIYDLLEESQNQQEKNEQDLLALD

SEQ ID NO: 1532 - protein, 642 aa, Artificial Sequence
  Recombinant HIV protein
AENLWVTVYYGVPVWKEATTTLFCASDAKAYVTEKHNVWATHACVPTDPNPQEVVLENVTENFNMWKNNMVEQMHEDIISLWEQSLKPCVKLTPLCVTLNCTDKLRNDTSGTNSSSWEKVQKGEIKNCSFNITTGIRGRVQEYSLFYKLDVIPIDSRNNSNNSTEFSSYRLISCNTSVCTQACPKISFEPIPIHYCAPAGFAILKCNDKKFNGTGPCKNVSTVQCTHGIKPVVSTQLLLNGSLAEEEVVIRSENFTNNVKSIIVQLNKSVVINCTRPNNNTRKSIHIGAGKALYTGEIIGDIRQAHCNLSRAQWNNTLKQIVIKLREQFGNKTIVFNQSSGGDVEIVMHSFNCGGEFFYCNSTQLFNSTWNGNDTWNDTWKDTTNDNITLPCRIKQIVNMWQKVGKCMYAPPIRGQIRCSSKITGLILTRDGGTNGTNETETFRPGGGNMKDNWRSELYKYKVVKIEPLGIAPTKCKRRVVGRRRRRRAVGTIGAMFLGFLGAAGSTMGAASLTLTVQARLLLSGIVQQQNNLLRAPEAQQHLLQLTVWGIKQLQARVLAVERYLRDQQLLGIWGCSGRLICCTNVPWNTSWSNRSLNYIWDNMTWMQWDREINNYTDYIYTLLEDAQNQQEKNEQELLELD

SEQ ID NO: 1533 - protein, 649 aa, Artificial Sequence
  Recombinant HIV protein
AENLWVTVYYGVPVWKEATTTLFCASDAKAYETEKHNVWATHACVPTDPNPQEVVLGNVTENFNMWKNNMVEQMHEDIISLWDESLKPCVKLTPLCVTLNCTDEVKTSYANKTSNETYKTSNETFGEIKNCSFSVPTGIKDKVQNVYALFYKLDVIPIDDNNNSSKNNNGSYSSYRLINCNTSVCTQACPKVSFEPIPIHYCAPAGFAILKCNNKTFNGTGPCTNVSTVQCTHGIRPVVSTQLLLNGSLAEEEVVIRSENFTNNAKTIIVHLKKSVEINCTRPGNNTRKSIHIGPGRAFYATGDIIGDIRQAHCNLSSVQWNDTLKQIVIKLGEQFGTNKTIAFNQSSGGDPEIVMHSFNCGGEFFYCNTTQLFNSTWEFHGNWTRSNFTESNSTTITLPCRIKQIVNMWQEVGKCMYAPPIRGQIRCSSNITGLLLTRDGGVNGTRETFRPGGGDMRDNWRSELYKYKVVKIEPLGVAPTKCKRRVVGRRRRRRAVGTIGAMFLGFLGAAGSTMGAASITLTVQARQLLSGIVQQQNNLLRAPEAQQHMLQLTVWGIKQLQARVLAVERYLRDQQLLGIWGCSGKLICCTAVPWNASWSNKSQDYIWNNMTWMQWDKEINNYTNLIYSLLEDSQNQQEKNEHELLELD

SEQ ID NO: 1534 - protein, 634 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTKCRRRTVGRRRRRRAVGIGAVFLGFLGAAGSTMGAASITLTVQARQLLAGIVQQQSNLLRAPEAQQQMLRLTVWGIKQLQARVLAVERYLKDQQLLGLWGCSGRIICCTNVPWNSSWSNKSYDEIWDSMTWLQWDREISNYSDIIYNLIEESQIQQEKNEQDLLALD

SEQ ID NO: 1535 - protein, 647 aa, Artificial Sequence
  Recombinant HIV protein
AENLWVTVYYGVPVWRDADTTLFCASDAKAHETEVHNVWATHACVPTDPNPQEIHLANVTENFNMWKNNMAEQMQEDVISLWDQSLKPCVKLTPLCVTLNCTKANFTKANSTNTSTNVSSTTGNITEEVRIENRTEEVRNCSFNMTTELRDKQQKVYALFYKLDLAQIGDKNSSNYRLINCNTSVCKQACPKISFDPIPIHYCTPAGYAILKCNDKNFNGTGPCKNVSSVQCTHGIKPVVSTQLLLNGSLAEEEIIIRSENLTNNAKTIIVHLNKSVEIKCTRPFNNTRTSVTIGPGQVFYKTGDIIGDIRRAYCEINRTEWNTTLKQVTKKLEKEFKNKTIIFQPPSGGDLEITMHHFNCRGEFFYCNTSHLFNSTWWMGNETREGCNSTNCTIILPCKIKQIINLWQKVGQCMYAPPIRGNISCVSNITGILLTRDGGVNNSTNETFRPGGGNIKDNWRNELYKYKVVQIEPLGIAPTRCKRRVVGRRRRRRAVGIGAMIFGFLGAAGSTMGAASITLTVQARQLLSGIVQQQSNLLRAPEAQQHLLQLTVWGIKQLQARVLAVERYLKDQTFLGLWGCSGKIICCTAVPWNSTWSNKSYEEIWENMTWIEWEREISNYTNQIYGILTESQNQQDRNEKDLLELD

SEQ ID NO: 1536 - protein, 639 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVQIEPLGIAPTRCRRRVVGRRRRRRAVGIGAMIFGFLGAAGSTMGAASITLTVQARQLLSGIVQQQSNLLRAPEAQQHLLQLTVWGIKQLQARVLAVERYLKDQKFLGLWGCSGKIICCTAVPWNSTWSNKSYEEIWNNMTWIEWEREISNYTNQIYEILTKSQDQQDRNEKDLLELD

SEQ ID NO: 1537 - protein, 636 aa, Artificial Sequence
  Recombinant HIV protein
AENLWVTVYYGVPVWRDADTTLFCASDAKAHVTEVHNVWATHACVPTDPNPQEIYLENVTEYFNMWKNNMAEQMQEDVISLWDQSLKPCVRLTPLCVTLHCTYANLTNVTNTAKGSDIIGNITDEVRNCSFNMTTELKDKKQKIYALFYKLDIVQVNKSSSEYRLINCNTSVCKQACPKISFDPIPIHYCTPAGYAILKCNDKNFNGTGECNNVSSVQCTHGIKPVVSTQLLLNGSLAEDEIVIRSENITNNAKTIIVHLNKSVEIKCIRPSNNTRTSMTIGPGQVFYRTGDIIGDIRQAYCEINQTKWNETLKQVAGKLKEHFNKTIIFRPPSGGDLEITMHHFNCRGEFFYCNTTQLFNSTWIGNETIGNETMKGGNNGTITLPCRIKQIINMWQGVGQCMYAPPISGNISCASNITGILLTRDGGDDGATNETFRPVGGNIKDNWRSELYKYKVVQIEPLGIAPTRCKRRVVGRRRRRRAVGIGAMIFGFLGAAGSTMGAASITLTVQARQLLSGIVQQQSNLLRAPEAQQQLLQLTVWGIKQLQARVLAVERYLKDQKFLGLWGCSGKTICCTAVPWNSTWSGNRSYEDIWNNMTWVQWEREISNYTSQIYEILTESQNQQERNEKDLLELD

SEQ ID NO: 1538 - protein, 636 aa, Artificial Sequence
  Recombinant HIV protein
AENLWVTVYYGVPVWKEATTTLFCASDAKAYDQEIHNIWATHACVPTDPNPQEVELKNVTENFNMWKSNMVEQMHEDIISLWDQSLKPCVKLTPLCVTLKCTDLNVTNSNSTDHSTNSSLEAKGEIKNCSFNITTTPRDKIQKEYAIFYKQDVVPIKNDNISYRLISCNTSVCTQACPKVTFEPIPIHYCAPAGFAILKCNDKGFNGTGPCTNVSTVQCTHGIRPAISTQLLLNGSLAEDKVVIRSENFTDNAKIIIVHLNETVKINCTRPNNNTRKSIHIAPGRAFYATGEIIGDIRKAYCTINESEWNNTLQKIVVTLREQFRNKTIVFNQSSGGDPEVTMHTFNCGGEFFYCNTAQLFNSSWDTNTNGNDTQGPSENNTIILPCRIKQIINMWQRVGKCIYAPPISGQIRCLSNITGLILTRDGGNSSLSSPEIFRPGGGDMRDNWRSELYKYKVVQIEPLGIAPTRCKRRAVGRRRRRRAVGIGALFLGFLGAAGSTMGAASVTLTVQARQLLSGIVQQQSNLLRAPEAQQHLLQLTVWGIKQLQARVLAMESYLKDQQLLGIWGCSGKLICCTTVPWNTSWSNKSLDQIWNNMTWREWEKEIDNYTDLIYTLIEKSQNQQEKNEQELLELD

SEQ ID NO: 1539 - protein, 635 aa, Artificial Sequence
  Recombinant HIV protein
AENLWVTVYYGVPVWKEANTTLFCASDAKAYDTEAHNVWATHACVPTDPNPQEVVLENVTENFNMWKNHMVEQMHEDIISLWDQSLKPCVKLTPLCVTLNCTDLVNSNITRVDNTTEKEMKNCSFNVTSGIRDKVQKEYALLYKLDIVQIDNDNTSHRDNTSYRLISCNTSVCTQACPKISFEPIPIHFCAPAGFAILKCNDKKFNGTGPCTNVSTVQCTHGIRPVVSTQLLLNGSLAEEEVVIRSENFTNNVKNIIVQLNESVQINCTRHNNNTRKSINIGPGRAFYATGKIIGDIRQAHCNISREKWQNTLKQIVKKLREQFKNKTIAFAPSSGGDPEIVMHSFNCNGEFFYCNTTKLFTSTWNSTWNSTWNNTEGSNSTVITLPCRIRQIINMWQEVGKCMYAPPIQGQIKCSSNITGLLLTRDGGVDTTKETFRPGGGNMKDNWRSELYKYKVVRIEPLGVAPTKCKRRVVGRRRRRRAVGIGAMFLGFLGAAGSTMGAASITLTVQARLLLSGIVQQQSNLLRAPEAQQHLLQLTVWGIKQLQARVLAVERYLKDQQLLGIWGCSGKLICCTAVPWNASWSNKSQDTIWGNMTWMQWEREIDNYTDLIYNLLEESQNQQEKNEQELLALD

SEQ ID NO: 1540 - protein, 620 aa, Artificial Sequence; identical to SEQ ID NO: 1070
  Recombinant HIV protein

SEQ ID NO: 1541 - protein, 635 aa, Artificial Sequence
  Recombinant HIV protein
AENLWVTVYYGVPVWKEATTTLFCASDAKAYETEKHNVWATHACVPTDPDPQEVVLGNVTENFNMWKNNMVEQMHEDIISLWDQSLKPCVKLTPLCVTLNCTDELRNGTYANVTVTEKGEIKNCSFNITTAIRDKVQKTYALFYRLDVVPIDNNHGNSSSNYSNYRLINCNTSVCTQACPKVSFEPIPIHYCAPAGFAILKCNNKKFNGTGPCKNVSTVQCTHGIRPVVSTQLLLNGSLAEEEVVIRSENFTDNAKTIIVQLNDSVIINCTRPNNNTRKGITIGPGRVFYTGEIVGDIRQVHCNLSSAKWNSTLKQVVTKLREQFGNKTIVFNQSSGGDPEIVMHSFNCGGEFFFCNTTQLFNSTWNINGTWHGTTVSNKTIILPCRIKQIINMWQEVGKCMYAPPIRGQIRCSSNITGLLLTRDGGNNNSTTEIFRPGGGDMRDNWRSELYKYKVVKIEPLGIAPTKCRRRVVGRRRRRRAVGTIGAMFLGFLGAAGSTMGAASVTLTVQARLLLSGIVQQQNNLLRAPEAQQHLLQLTVWGIKQLQARVLAVERYLRDQQLLGIWGCSGRLICCTNVPWNTSWSNKSLNDIWDNMTWMEWDREINNYTSLIYNLLEDAQNQQEKNEQELLELD

SEQ ID NO: 1542 - protein, 628 aa, Artificial Sequence
  Recombinant HIV protein
AENLWVTVYYGVPVWKEATTTLFCASDAKAYDTEVHNVWATHACVPTDPNPQEIVLENVTENFNMWKNNMVEQMHEDIISLWDQSLKPCVKLTPLCVTLHCTNLKNATNTKSSNWKEMDRGEIKNCSFKVTTSIRNKMQKEYALFYKLDVVPIDNDNTSYKLINCNTSVCTQACPKVSFEPIPIHYCAPAGFAILKCNDKKFNGSGPCTNVSTVQCTHGIRPVVSTQLLLNGSLAEEGVVIRSENFTDNAKTIIVQLKESVEINCTRPNNNTRKSITIGPGRAFYATGDIIGDIRQAHCNISGEKWNNTLKQIVTKLQAQFGNKTIVFKQSSGGDPEIVMHSFNCGGEFFYCNSTQLFNSTWNNTIGPNNTNGTITLPCRIKQIINRWQEVGKCMYAPPIRGQIRCSSNITGLLLTRDGGKEISNTTEIFRPGGGDMRDNWRSELYKYKVVKIEPLGVAPTKCKRRVVGRRRRRRAVTLGAMFLGFLGAAGSTMGARSLTLTVQARQLLSGIVQQQNNLLRAPEAQQHLLQLTVWGIKQLQARVLAVERYLKDQQLLGIWGCSGKLICCTAVPWNASWSNKSLDQIWNNMTWMEWEREIDNYTNLIYTLIEESQNQQEKNEQELLELD

SEQ ID NO: 1543 - protein, 615 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDQSLKPCVKLTPLCVTLNCTNASVNATYNGEMKNCSFNATTAIRDKKQQVRALFYSLDIVPLEGNNSSYRLISCNTSACTQACPKVSFDPIPIHYCTPAGYAILKCNDEKFNGTGPCHNVSTVQCTHGIKPVVSTQLLLNGSLAEKEIIIRSENLTNNAKTIIVHLNKAVEIVCVRPNNNTRKSIRIGPGQTFYANDIIGDIRQAHCNISESKWNDTLRQVGAKLAEHFNNNTIRFEPSSGGDLEITTHSFNCRGEFFYCNTSGLFNGTYNHTDTGGNSTNITLPCRIKQIINMWQEVGRCIYAPPVEGNIICISNITGLLLLRDGGHNSTNETFRPGGGDMRDNWRSELYKYKVVEIKPLGVAPTECKRRVVGRRRRRRAVGIGAMFLGFLGAAGSTMGAASITLTVQARQLLSGIVQQQSNLLRAPEAQQHMLQLTVWGIKQLQARVLSIERYLKDQQLLGLWGCSGKLICCTSVPWNHSWSNKSQKDIWENMTWMQWDREINNYTNTIYSLLEESQSQQEKNEKDLLALD

SEQ ID NO: 1544 - protein, 631 aa, Artificial Sequence
  Recombinant HIV protein
AENLWVTVYYGVPVWKEATTTLFCASDAKAYDTEKHNVWATHACVPTDPNPQEIVLKNVTENFNMWKNNMVEQMHEDIISLWDQSLKPCVKLTPLCVTLNCTDYFGNTTNNSSREAMMKKCSFNITTNIRDKGQKEYALFYKTDVVPIDNDNTSYRMISCNTSVCTQACPKISFEPIPIHFCAPAGFAILKCFNKTFNGTGPCTNVSTVQCTHGIRPVVSTQLLLNGSLAEEEVVIRSENLTDNTKIIIVQLNKSVVINCTRPNNNTRKSIHIGPGRAFYATGGVIGDIRQAHCNISRKDWYEALQQIAIKLREQFENRTIAFNRSSGGDPEIVTHSFNCAGEFFYCNTTQLFNNTWNGTGWSDNSENTTGNGTITLPCRIKQIVNLWQEVGKCMYAPPIRGLIRCSSNITGLLLTRDGGNNTTTNGTQTEIFRPGGGDMRDNWRSELYKYKVVKIEPLGVAPTRCKRRVVGRRRRRRAAALGALFLGFLGAAGSTMGAASMTLTVQARLLLSGIVQQQNNLLRAPEAQQHLLQLTVWGIKQLQARVLALERYLRDQQLLGIWGCSGKLICCTSVPWNTSWSNKSYKEIWENMTWIQWEREIDNYTGIIYELIEESQNQQEKNEQELLELD

SEQ ID NO: 1545 - protein, 630 aa, Artificial Sequence
  Recombinant HIV protein
AENLWVTVYYGVPVWREADTTLFCASDAKGYDTEAHNVWATHACVPTDPRPQEMYLENVTENFNMWKNSMVEQMHTDIISLWDESLKPCVKLTPLCVTLDCQAFNSSSHTNSSIAMQEMKNCSFNVTTELRDKKKKEYSFFYKTDIEQINKNGRQYRLINCNTSACTQACPKVSFEPIPIHFCAPAGFAILKCNEKHFNGKGPCKNVSTVQCTHGIKPVVSTQLLLNGSLAEEEVVIRVENTIDNAKTIIVQLAKPVKINCTRPNNNTRKSIRIGPGQTFYATGDIIGNIRKAYCNVSKREWNNTLQQVAAQLSKSFNNTKIVFEKHSGGDLEVITHSFVCGGEFFYCNTSGLFNSTWTNSTWTNSTTGSNGTESNDTITLQCEIKQFINMWQRVGRCMYAPPIPGVIRCESDITGLLLTRDGPNSTQNETFRPGGGDMRDNWRSELYKYKVVQIEPLGVAPTHCKRRVVGRRRRRRAVGLGAVFFGFLGAAGSTMGAASITLTVQARQLLSGIVQQQSNLLKAPEAQQQLLRLTVWGIKQLQARVLALERYLKDQQLLGIWGCSGKLICCTTVPWNSSWSNKNYTDIWDNMTWLQWDREISNYTDEIYRLIEQSQNQQEKNEQDLLALD

SEQ ID NO: 1546 - protein, 640 aa, Artificial Sequence
  Recombinant HIV protein
AENLWVTVYYGVPVWKDAETTLFCASDAKAYDTEVHNVWATHACVPTDPDPQEMYLENVTENFNMWKNNMVEQMHEDIISLWDQSLKPCVKLTPLCVTLLCKDVNNSTNKTTIYKEMNGEIKNCSFNMTTELKDKTKKMYALFNRYDVVQISEQNNSQSDNSTDREYMLTSCNASTCTQACPKVTFEPIPIHYCAPAGFAILKCRDKGFNGTGPCKNVSTVQCTHGIKPAVSTQLLLNGSLAEENITIRSENITNNAKTIIIQLKKPVNITCIRPGNNTRKSVRIGPGQTFYATGDIIGDIRQAHCNVSRGKWNNTLNQVATQLRKYFNNNTAIIFTNSSGGDSEITTFSFNCAGEFFYCNTSGLFNSTWYSNSTNSSNHTNGTDDITLQCRIKQIVNMWQRVGQCMYAPPIRGEIRCESNITGILLTRDGGNNGSKANETFRPGGGDMRDNWRSELYKYKVVKIEPIGIAPTHCKRRVVGRRRRRRAVGLGAFFLGFLGVAGSTMGAASMTLTVQARHLLSGIVQQQSNLLKAPEAQQQLLRLTVWGIKQLQARVLALERYLRDQQLLGIWGCSGKLICCTTVPWNSTWSNKTYNDIWDNMTWLQWDKEINNYTETIYWLLEQSQHQQEKNEQELLSLD

SEQ ID NO: 1547 - protein, 636 aa, Artificial Sequence
  Recombinant HIV protein
AENLWVTVYYGVPVWKDAVTTLFCASDAKAYSTEVHNVWATHACVPTDPNPQEMPLENVTENFNVWKNDMVEQMHEDIINLWDQSLKPCVKLTPLCVTLNCSNFSGDNSTNTSVSDDMQGEIKNCSFNVTTGLKDKKQKMDALFHRRDVVQISNGNNSYYMLISCNTSTCAQACPKITFEPIPIHYCAPAGFAILKCKDKGFNGTGSCKNVSTVQCTHGIKPVVTTQLLLNGSTAEEEIVIRSENITDNARTIIVQLTKPINITCIRPGNNTRKSVRIGPGQTFYATGAIIGNIRQAHCNVSKTEWNDTLRQVAEQLSKHFPNATTITFANASGGDLEITTHSFNCGGEFFYCNTSKLFSSTWDNSTWGNNTWGNSTGDNNETITLQCKIKQIINMWQQVGRCMYAPPIQGEIRCESNITGLLLTRDGGANSSTNETFRPGGGDMRDNWRSELYKYKVVKIEPLGVAPTRCKRRVVGRRRRRRAVGLGAVFIGFLGAAGSTMGAASITLTVQARQLLSGIVQQQSNLLKAPEAQQHLLRLTVWGIKQLQARVLALERYLKDQQLLGIWGCSGKLICCTNVLWNTTWSNKTYNDIWDNMTWLQWDKEISNYTDIIYGLIEESQIQQEKNEQDLLALD

SEQ ID NO: 1548 - protein, 637 aa, Artificial Sequence
  Recombinant HIV protein
AENLWVTVYYGVPVWRDAETTLFCASDAKAYETEAHNVWATHACVPTDPSPQEIHLENVTEKFNMWKNNMVEQMHIDIISLWDQSLKPCVKLTPLCVTLNCVNSNFTNNSSNSSNNSNIDMQEEIKNCSFNMTTELRDKRRQIHSLFYKLDVVQINENNSQQYRPINCNTSACTQACPKMSFEPIPIHYCAPAGFAILKCNNKEFNGTGPCNNVSTVQCTHGIKPVVSTQLLLNGSLAEEKVIIRSENITNNAKTIIVQLAESVSITCTRPANNTIRGERIGPGQTFYTRDTIIGDIRQAHCNVSKDWNNTLQQVATQLGKYFNNKTIIFANHSGGDIEITTHSFNCGGEFFYCNTSKLFDSIWNRTNGSNYTRLGDDTETNDPITLQCRIKQIVRMWQTVGQCMYAPPIRGEIKCESNITGLLLTRDGGNNNSMNETFRPGGGDMRDNWRSELYKYKVVQIEPLGVAPTFCKRRVVGRRRRRRAVGLGAVFLGFLGAAGSTMGAASITLTVQARQLLSGIVQQQSNLLRAPEAQQHLLKLTVWGIKQLQARVLALERYLRDQQLLGIWGCSGKLICCTAVQWNSSWSNKTYEDIWNNMTWMQWDREISNYTEIIYNLIEESQNQQEKNEQDLLALD

SEQ ID NO: 1549 - protein, 646 aa, Artificial Sequence
  Recombinant HIV protein
AENLWVTVYYGVPVWRDAETTLFCASDAKAYDAEAHNIWATHACVPTDPSPQEIHIKNVTENYNMWKNNMVEQMHIDIISLWDQSLKPCVQLTPLCVTLNCSNYNGSSTSNSTSPPPATSFNDTSMIGEIKNCSYNMTTELRDKKKKVYSLFYKLDVVPLSNDSSNTQYRLINCNSSTCTQACPKVSFEPIPIHFCAPAGFAILKCNEKNFNGTGPCRDVSTVQCTHGIKPVVSTQLLLNGSLAEGEVVIRSENISNNAKNIIVQLFKPVNITCIRPNNNTRKSIHIGPGQAFYAWGDITGDIRQAHCKVNKTEWEEALQKVATKFMKYFTNKTINFANASGGDLEITTHTFNCGGEFFYCSTSNLFNSTCTNNNGTANCTNTNGTALNETITLQCRIKQIVRMWQRVGQCMYAPPIQGVIRCESNITGIILTRDGGDSNDTNGNETFRPGGGDMRDNWRSELYKYKVVQLEPLGVAPTQCRRRVVGRRRRRRAVGMGALFLGFLGAAGSTMGAASVTLTVQARQLLSGIVQQQSNLLRAPEAQQHLLKLTVWGIKQLQARILALETYLRDQQLLGLWGCSGKLICCTNVPWNSSWSNKTFEYIWDNMTWLEWDREINNYTEIIYNLIEQSQNQQEKNEQDLLALD

SEQ ID NO: 1550 - protein, 656 aa, Artificial Sequence
  Recombinant HIV protein
AENLWVTVYYGVPVWKDAETTLFCASDAKGYEREAHNIWATHACVPTDPNPQELHLENVTEDFNMWKNTMVEQMHEDIISLWDQSLKPCVKITPLCVTLNCIDASFNSSNSSLNNSSNSSLNNSSLNSSSNIGEMQMKNCSFNVTTELRDKQKKEYALFYRQDIVQINENKNNSNQSKENNSSQSHYMLINCNTSTCAQACPKVSFQPIPIHYCAPAGFAILKCNDKGFSGTGKCKNVSTVQCTHGIKPVVTTQLLLNGSTAEGNVTIRSENITNNAKTIIVQLVKPVKINCTRPGNNTRKSVHIGPGQALYATGNIVGDIRQAHCNVSGKEWNDTLSQVVTQLRKYFNNTIIKFNSSSGGDVEITTHSFNCGGEFFYCDTSSLFNSTWENNTNSNWDNSTITLQCRIKQFINMWQRVGRCMYAPPIPGVIRCESNITGILLTRDGGVNNDTNTTETFRPGGGDMRDNWRSELYKYKVVKIEPLGVAPTHCKRRVVGRRRRRRAVGLGAVFLGFLGAAGSTMGVASITLTVQARQLLSGIVQQQSNLLKAPEAQQQLLRLTVWGIKQLQARVLALERYLKDQQLLGIWGCSGRLICCTNVPWNTSWSNKTYSDIWDNMTWLQWDKEISNYTDIIYKLIEESQNQQEKNEQDLLALD

SEQ ID NO: 1551 - protein, 650 aa, Artificial Sequence
  Recombinant HIV protein
AENLWVTVYYGVPVWRDAETTLFCASDAKAYDTEAHNVWATHACVPTDPNPQEIHLKNVTENFNMWKNAMVEQMNEDIISLWDQSLKPCVKLTPLCVTLHCHNFTSSSNSSNSTVSPQMRGEIQNCSFNTTTLLKDKKKKEYALFYRQDIVPLDTNGTNIDTNGTNSSQYMLINCNTSTCAQACPKITFEPIPIHYCAPAGFAILKCRDKEFNGTGTCKNVSTVQCTHGIKPVVSTQLLLNGSTAEEGIVIRSKNISANAKTIIVQLDEPVRINCTRPGNNTRKSVHLGPGQAFYATGDIIGDIRQAYCNVSGTEWNKTLHRVATKLKGYFKSNTTIIFTKPSGGDLEITTHSFNCGGEFFYCNTSNLFNGTLYKNNTWMFNGTLYNNTNESSTSGTITIKCRIKQIINMWQTVGQCMYAPPIPGEIRCESNITGLLLTRDGEGDEKANETFRPIGGNMRDNWRSELYKYKVVKIEPLGVAPTPCKRRVVGRRRRRRAVGLGAVFLGFLGAAGSTMGAASITLTVQARQLLSGIVQQQSNLLKAPEAQQHLLKLTVWGIKQLQARVLALERYLTDQQLLGIWGCSGKLICCTTVPWNSSWSNKTYNDIWDNMTWLQWDKEISNYTDTIYKLLEESQNQQEKNEKDLLALD

SEQ ID NO: 1552 - protein, 628 aa, Artificial Sequence
  Recombinant HIV protein
AENLWVTVYYGVPVWKDADTTLFCASDAKAYDKEVHNVWATHACVPTDPNPQEIKLTNVTENFNMWKNHMVEQMHTDIISLWDQSLKPCVKLTPLCVTLNCTNATTNGTIEDGAKNCSFNMTTELRDKQKKVYSLFYKLDIVKIRENNNSDNYTYRLINCNTSTCTQACPKVTFEPIPIHYCAPAGFAILKCTDKKFNGTGPCSNVSSVQCTHGIKPVVSTQLLLNGSLAEEGIIIRSEDITNNAKTIIVQLTKPVNITCVRPNNNTRRGIHIGPGQAFYARDSIIGDIRQAYCNVSKAEWNETLQQVAKKLRDNYGNKTIIFTSSSGGDLEITTHSFNCGGEFFYCNTSSLFNSTWNWNGTSIQGPNDTQSNGTITLPCRIKQIVNMWQRAGQCMYAPPIPGIIKCESNITGLLLVRDGGNNSGSNETFRPTGGDMRDNWRSELYKYKVVEIEPLGVAPTRCKRRVVGRRRRRRAVGLGAVFLGFLGAAGSTMGAASITLTVQARQLLSGIVQQQSNLLRAPEAQQHLLKLTVWGIKQLQARVLAVERYLKDQQLLGIWGCSGKLICCTNVPWNSSWSNKSQEEIWGNMTWLQWDKEISNYTSIIYSLIEESQNQQEKNEQELLALD

SEQ ID NO: 1553 - protein, 631 aa, Artificial Sequence
  Recombinant HIV protein
AENLWVTVYYGVPVWREADTTLFCASDAKAYSTEVHNVWATHACVPTDPDPQEILLKNVTEDFNMWKNNMVEQMHADIINLWDQSLKPCVKLTPLCVTMQCTDMTNISIKLASIANTSIAEEMQGEIKNCSFNVTELRNKRKKEYAFFYKQDIVQINNNESMLISCNTSTCTQACPKVSFEPIPIHFCAPAGFAILKCNDKKFNGTGPCENVSTVQCTHGIKPVVSTQLLLNGSLAEEEVVIRSENITNNAKTIIVQLDKPVNITCVRPNNNTIKSVRIGPGQAFYTAGQVIGDIRKAYCEVNRTEWKSALNQVASKLRENFQNASTIKFNEHSGGDIEITTHMFNCKGEFFYCNTSSLFNYTFSNSTEDNNPSNATITLQCRIRQVVNMWQRVGLCMYAPPIKGKLRCESNITGLLLTRDGGNNNNATETFRPGGGDMRDNWRSELYKYKVVQIEPLGVAPTYCKRRVVGRRRRRRAVVGLGAVFLGFLGAAGSTMGAASITLTVQARQLLSGIVQQQSNLLRAPEAQQQLLKLTVWGIKQLQARVLALERYLRDQQLLGLWGCSGKLICCTTVPWNSSWSNKTYNSIWDNMTWMQWDREINNYTEIIYNLIEESQNQQEQNEKDLLALD

SEQ ID NO: 1554 - protein, 631 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVQIEPLGIAPTRCKRRVVGRRRRRRAVGIGAMIFGFLGAAGSTMGAASITLTVQARQLVSGIVQQQSNLLRAPEAQQHLLQLTVWGIKQLQARVLAVERYLKDQKFLGLWGCSGKIICCTAVPWNSTWSNRSFEEIWSNMTWIEWEREISNYTNQIYEILTESQNQQDRNEKDLLELD

SEQ ID NO: 1555 - protein, 630 aa, Artificial Sequence
  Recombinant HIV protein
AENLWVTVYYGVPVWKDADTTLFCASDAKAHETEVHNVWATHACVPTDPNPQEIHLENVTENFNMWKNKMVEQMQEDVISLWDQSLKPCVKLTPLCVTLTCTNATLNCTNLTNGNKTTNVSNIIGNLTDEVRNCSFHMTTELRDKKQKVYALFYKLDIVQINSSEYRLINCNTSVCKQACPKISFDPIPIHYCTPAGYAILKCNDKNFNGTGPCKNVSSVQCTHGIKPVVSTQLLLNGSLAEEEIIISSENLTNNAKTIIVHLNKSVEISCTRPSTNTRTSIRIGPGQVFYRTGDITGDIRKAYCEINETKWNEALKQVAGKLKEHFNKTIIFQPPSGGDLEITMHHFNCRGEFFYCDTTQLFNRTWGENETREGRNITLPCKIKQIVNMWQGAGQCMYAPPISGIIKCVSNITGILLTRDGGANNSASETFRPGGGNIKDNWRSELYKYKVVQIEPLGIAPTRCKRRVVGRRRRRRAVGIGAMIFGFLGAAGSTMGAASITLTVQARQLLSGIVQQQSNLLRAPEAQQHLLQLTVWGIKQLQARVLAVERYLKDQKFLGLWGCSGKIICCTAVPWNSTWSNKSYEEIWNNMTWIEWEREISNYTNQIYEILTESQDQQDRNEKDLLELD

SEQ ID NO: 1556 - protein, 655 aa, Artificial Sequence; identical to SEQ ID NO: 1071
  Recombinant HIV protein

SEQ ID NO: 1557 - protein, 635 aa, Artificial Sequence; identical to SEQ ID NO: 1072
  Recombinant HIV protein

SEQ ID NO: 1558 - protein, 643 aa, Artificial Sequence; identical to SEQ ID NO: 1073
  Recombinant HIV protein

SEQ ID NO: 1559 - protein, 645 aa, Artificial Sequence
  Recombinant HIV protein
AENLWVTVYYGVPVWREAKTTLFCASDAKAYETEVHNVWATHACVPTDPNPQEIVLGNVTENFNMWKNDMADQMHEDVISLWDQSLKPCVKLTPLCVTLNCTDTNVTGNRTVTGNSTNNKKGTGTNGTGIYNIEEMKNCSFNVTTELRNKKHKEYALFYRLDIVSLNNKPNEYRLINCNTSACTQACPKVSFDPIPIHYCAPAGYAILKCNNKTFNGTGPCYNVSTVQCTHGIRPVVSTQLLLNGSLAEGEIIIRSENLTENTKTIIVHLNESIEINCTRPNNNTRKSVRIGPGQAFYATNDVIGDIRQAHCNISTDRWNKTLQQVMKKLGEHFPNKTIQFKPHAGGDIEITMHSFNCRGEFFYCNTSNLFNSTYHSNNGTYKYNGNSSLPITLQCKIKQIVRMWQGVGQCMYAPPIAGNITCRSNIAGILLTRDGGFNTTNNTETFRPGGGDMRDNWRSELYKYKVVEIKPLGIAPTKCKRRVVGRRRRRRAVGIGAVFLGFLGAAGSTMGAASITLTVQARQLLSGIVQQQSNMLKAPEAQQHMLQLTVWGIKQLQARVLAIERYLKDQQLLGIWGCSGRLICCTAVPWNSSWSNRSEADIWDNMTWMQWDREINNYTETIFRLLEDSQNQQEKNEKDLLELD

SEQ ID NO: 1560 - protein, 637 aa, Artificial Sequence
  Recombinant HIV protein
AENLWVTVYYGVPVWKEANAPLFCASDAKAYEKEVHNVWATHACVPTDPNPQELDLVNVTENFNMWKNDMVDQMHEDIISLWDESLKPCVKLTPLCVTLNCTNANINNDTVANSGTFKVDNSSNVVKNCSFNITTEIRDKKKKEYSLFYRLDILPLDNSSESKNYSEYVLINCNASTCTQACPKVSFDPIPIHYCAPAGYAILKCKDKTFNGTGPCSNVSTVLCTHGIKPVVSTQLLLNGSLAEEGIVIRSENLTNNAKTIIVQLNEPVEIMCVRPGNNTRKSVRIGPGQTFYATGDIIGDIRQAHCNISRSDWNKTLQEVGKKLREYFHNKTIRFKPAVVGGDLEITTHSFNCRGEFFYCNTSELFTGEYNGTEYKNTSNSNPNITLPCRIKQFVNMWQRVGRCMYAPPIEGNITCNSSITGLLLTWDGGNNTNGTETFRPGGGDMRDNWRSELYKYKVVEIKPLGIAPTSCKRRVVGRRRRRRAVGIGALFLGFLGAAGSTMGAASITLTVQARQLLSGIVQQQSNLLRAPEAQQHMLQLTVWGIKQLQTRVLAIERYLKDQQLLGIWGCSGKLICCTAVPWNTSWSNKTEQDIWNLTWMQWDREVSNYTDIIYRLLEDSQIQQENNEKDLLALD

SEQ ID NO: 1561 - protein, 630 aa, Artificial Sequence
  Recombinant HIV protein
AENLWVTVYYGVPVWKDAKTTLFCASDAKAYEKEVHNVWATHACVPTDPNPQEIVLGNVTEDFNMWENDMVDQMHEDIISLWDQSLKPCVKLTPLCVTLNCTNVNVTRGNNTQGYNTNSNNTDGGMRNCSFNITTELRDKKKKEYALFYKLDIVPLNVSTKEYRLINCNTSTCTQTCPKVSFDPIPIHYCAPAGYAILKCNNKTFTGTGPCLNVSTVQCTHGIKPVVSTQLLLNGSLAEEEIIIRSKNLTNNVNTIIVHLNESVEIVCTRPNNNTRKSIRIGPGQTFYATDIIGDIRQAYCNISKDDWNKTLQEVGRKLEEHFPNKTIEFKPSSGGDLEITTHSFNCRGEFFYCNTSGLFNSTYNSAYKSNDTTNSTITLPCRIKQIVNMWQEVGRCMYAPPIAGNITCKSNITGLLLVRDGGGESNETEIFRPGGGDMRDNWRSELYKYKVVEVKPLGIAPTECKRRVVGRRRRRRAVGIGAMFLGFLGAAGSTMGAASMTLTVQARQVLSGIVQQQSNLLRAPEAQQHMLQLTVWGIKQLQARVLAIERYLKDQQLLGIWGCSGKLICCTAVPWNSSWSNISQKIIWENMTWMEWDKEISNYTNTIYSLLEESQSQQEKNEKELLALD

SEQ ID NO: 1562 - protein, 622 aa, Artificial Sequence
  Recombinant HIV protein
AENLWVTVYYGVPVWKEATTTLFCASDAKSYEAEAHNIWATHACVPTDPNPQEIVLENVTENFNIWKNNMVEQMHDDIISLWDQSIKPCVKLTPLCVTLNCTEWKNATTNATNEGIGMKNCSFTEVRDKKKQAYALFYKLDVVQMNDDNSTNTSYRLINCNASTCTQACPKISFEPIPIHYCAPAGFAILKCNDKKFNGTGPCKNVSTVQCTHGIKPVVSTQLLLNGSLAEEEIIIRSKNLTNNAKIIIVHLNESVPINCTRPYDKVSYRTPIGVGRASYTTRIKGDIRQAHCNISGEKWNKTLQQVAVKLRDLLNQTAIIFKPSSGGDPEITTHSFNCGGEFFYCNTSGLFNNSVWTSNSTIGANGTITLPCRIKQIINMWQGVGKCMYAPPIEGQINCSSTITGLLLTRDGGVKNNSQNETFRPGGGDMRDNWRNELYKYKVVRIEPLGLAPTKCRRRVVGRRRRRRAIGLGALFLGFLGAAGSTMGAASLTLTVQARQLLSGIVQQQNNLLRAPEAQQHLLQLTVWGIKQLQARVLAVESYLKDQQLLGIWGCSGKHICCTNVPWNSSWSNRSLNEIWENMTWMEWEREIDNYTGLIYSLIEDSQIQQEKNEQELLKLD

SEQ ID NO: 1563 - protein, 631 aa, Artificial Sequence
  Recombinant HIV protein
AENLWVTVYYGVPVWKEATTTLFCASDAKAYKAEAHNIWATHACVPTDPNPREIQLENVTENFNMWKNNMVEQMHEDVISLWDQSLKPCVKLTPLCVTLNCIEWKNENETKGNKTVDPDKDIGMKNCSFNVTTEVRDKKKQVYALFYKLDVVQMNDNNTNTSYRLINCNTSACTQECPKVTFEPIPIHYCAPAGFAILKCNNKMFNGTGPCNNVSTVQCTHGIRPVVSTQLLLNGSLAEEEIIIRSENITNNAKIIIVHLNESVVINCTRPYNNIRQRTPIGLGQALYTTRRIEDIRRAHCNISEAAWKKTLEQVAKKLKVLFNRTTIDFKPSSGGDPEITTHSFNCGGEFFYCNTSKLFNHSVGENNTLSISNGVNTNITLPCKIKQIVNMWQGVGKCMYAPPIQGLIRCSSNITGLLLTRDGGNTSQNETFRPGGGDMRDNWRSELYKYKVIKIEPLGLAPTRCKRRVVGRRRRRRAIGLGAVFLGFLGAAGSTMGAASLTLTVQARQLMSGIVQQQNNLLRAPEAQQHLLQLTVWGIKQLQARVLAVESYLKDQQLLGVWGCSGRHICCTRVPWNSSWSNKSLDEIWGNMTWMEWEREISNYTGLIYNLIEESQIQQEKNEKDLLELD

SEQ ID NO: 1564 - protein, 632 aa, Artificial Sequence
  Recombinant HIV protein
AENLWVTVYYGVPVWKDAETTLFCASDAKAYDTEVHNVWATHACVPTDPNPQEIYMENVTEEFNMWKNNMVEQMHTDIISLWDQSLKPCVQLTPLCVTLDCSYNITNNITNSITNSSVNMREEIKNCSFNMTTELRDKNRKVYSLFYKLDVVQINNGNNSSNLYRLINCNTSACTQACPKVTFEPIPIRYCAPAGYAILKCNDKEFNGTGLCKNVSTVQCTHGIRPVVSTQLLLNGSLAEGKVMIRSENITNNVKNIIVQLNETVTINCTRPNNNTRKSVRIGPGQTFYATGDIIGDIRQAHCNVSGSQWNRALHQVVGQLREYWNTTIIFKNSSGGDLEITTHSFNCGGEFFYCNTSGLFNSNWTHNDTASMKPNDTITLPCRIKQIINMWQRVGQCIYAPPIQGVIRCESNITGLILTRDGGGNINESQIFRPGGGDMRDNWRSELYKYKVVRIEPLGVAPTKCKRRVVGRRRRRRAVVELGAVFIGFLGTAGSTMGAASITLTVQVRKLLSGIVQQQSNLLRAPEAQQHLLKLTVWGIKQLQARVLAVERYLRDQQLLGIWGCSGKLICCTNVPWNSSWSNKSEREIWENMTWLQWDKEISNYTHIIYELIEESQKQQEKNEQELLELD

SEQ ID NO: 1565 - protein, 630 aa, Artificial Sequence
  Recombinant HIV protein
AENLWVTVYYGVPVWREANTTLFCASDAKAYDTEVHNVWATHACVPTDPNPQEVVMGNVTEDFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTSVCTQACPKVSFEPIPIHYCAPAGFAILKCNNKTFNGKGPCRNVSTVQCTHGIKPVVSTQLLLNGSLAEEDIIIRSENFTNNGKNIIVQLKEPVKINCTRPGNNTRRSINIGPGRAFYATGAIIGDIRKAHCNISTEQWNNTLTQIVDKLREQFGNKTIIFNQSSGGDPEVVMHTFNCGGEFFYCNSTQLFNSTWFNNGTSTWNSTADNITLPCRIKQVINMWQEVGKCMYAPPIRGQIDCSSNITGLILTRDGGSNSSQNETFRPGGGNMKDNWRSELYKYKVVKIEPLGIAPTRCKRRVVGRRRRRRAVTLGAVFLGFLGAAGSTMGAASLTLTVQARLLLSGIVQQQSNLLRAPEAQQHMLQLTVWGIKQLQARVLAIERYLKDQQLLGIWGCSGKLICCTTVPWNTSWSNKSYDYIWNNMTWMQWEREIDNYTGFIYTLIEESQNQQEKNELELLELD

SEQ ID NO: 1566 - protein, 631 aa, Artificial Sequence
  Recombinant HIV protein
AENLWVTVYYGVPAWEDADTTLFCASDAKAYSTEKHNVWATHACVPTDPDPQEIPLENVTENFNMWKNNMVEQMHEDIISLWDESLKPCVMLTPLCVTLNCSAVNGTMNEQMKNCTFNITTEIRDKKKEEYALFYKLDIEQISKTANSTTANSNYSSYRLINCNVSTCKQACPKVTFEPIPIHYCAPAGFAILKCRDEDFNGTGPCKNVSTVQCTHGIKPVVSTQLLLNGSLAKGDIVIRSENLTNNAKVIIVQLNEPVQIVCIRPNNNTRRSIHLGPGRAFYATDIIGDIRQAHCNVTRGKWVNITKNVKEQLWKIFNKTTNITFNNTIFNSPAGGDLEITTHSFNCGGEFFYCNTSDLFNETNLSANHTDTNENITLQCRIKQIVRMWQRVGQCMYAPPIAGNITCISNITGLLLTRDGVNDTHDKENETFRPTGGDMRDNWRSELYKYKVIKLKPLGVAPTRCRRRVVGRRRRRRAVTLGALFLTFLGAAGSTMGAASLTLTVQARQLLSGIVQQQSNLLRAPEAQQHLLQLTVWGIKQLQARVLAVERYLKDQQLLGIWGCSGKLICCTNVPWNTSWSNKNLSEIWDNMTWIQWDREIDNYTQTIYSLLAESQIQQEKNEQDLLTLD

SEQ ID NO: 1567 - protein, 624 aa, Artificial Sequence; identical to SEQ ID NO: 1074
  Recombinant HIV protein

SEQ ID NO: 1568 - protein, 621 aa, Artificial Sequence; identical to SEQ ID NO: 1075
  Recombinant HIV protein

SEQ ID NO: 1569 - protein, 630 aa, Artificial Sequence; identical to SEQ ID NO: 1076
  Recombinant HIV protein

SEQ ID NO: 1570 - protein, 615 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLNCTSPAAHNESETRVKHCSFNITTDVKDRKQKVNATFYDLDIVPLSSSDNSSNSSLYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGDLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVEIKPLGIAPTECKRRVVGRRRRRRAVGIGAVFLGFLGAAGSTMGAASITLTVQARQLLSGIVQQQSNLLRAPEAQQHLLQLTVWGIKQLQARVLAIERYLQDQQLLGIWGCSGKLICCTAVPWNSSWSNKSKEEIWGNMTWMQWDKEVSNYTFTIYQLLEESQYQQEQNEKELLALN

SEQ ID NO: 1571 - protein, 628 aa, Artificial Sequence
  Recombinant HIV protein
AENLWVTVYYGVPVWREAKTTLFCASDAKAYEKEVHNVWATHACVPTDPNPQELVLGNVTENFNMWENDMVDQMHEDIISLWDQSLKPCVKLTPLCVTLECKNATRSNQTTYYDNMDKEIKNCSFNVTTELTDKKKNMRALFYRADIEPLDGNSNESINSSEGDKYILINCNTSTCAQACPKVTFDPIPIHYCAPAGYAILKCNNKTFNGIGPCKNVSTVQCTHGIKPVVSTQLLLNGSLSEEGIIIRSKNLTDNTKTIIVHLNESVAIVCTRPNNNTRKSIRIGPGQTFYATGEVIGDIRQAHCNISGEQWNRTLERIKDKLTEYFPDKIIKFNHSSGGDLEITTHTFNCRGEFFYCNTSILFTENENSSDNITLPCRIKQFVNMWQEVGRCMYAPPIAGNITCNSSITGLLLTRDGGLNNKENGTETFRPQGGDMRDNWRSELYKYKVVEIRPLGVAPTKCKRRVVGRRRRRRAVGIGAVFLGFLGVAGSTMGAASITLTAQARQVLSGIVQQQSNLLRAPEAQQHMLQLTVWGIKQLQARVLAIERYLKDQQLLGIWGCSGKLICCTAVPWEDSWSNRTQEEIWNNMTWMQWDKEISNYTDTIYKLLTESQSQQDKNEKDLLALD

SEQ ID NO: 1572 - protein, 632 aa, Artificial Sequence
  Recombinant HIV protein
AENLWVTVYYGVPVWKEAKTTLFCASDAKAYEREVHNVWATHACVPTDPNPQEMALGNVTENFNMWKNDMVDQMHEDIISLWDQSLKPCVKLTPLCVTLNCSNVNSSNVYTPMNSTLKNITEEMKNCSFNITTELRDKRRKENALFYKLDITPINGESNSREYRLINCNTSTCTQACPKVSFDPIPIHYCAPAGYAILKCNNETFEGTGPCNNVSTVQCTHGIKPVVSTQLLLNGSLAKEEIVIRSENLTDNAKTIIVHLKESVEIVCTRPGNNTRKSVRIGPGQTFYATGEIIGDTRQAHCNISEEKWNKTLQKVSKILQEHFPNKAIKFEPHSGGDLEITTHSFNCRGEFFYCNTTKLFNGTYNSTANSTGSVSNTTITLPCRIKQIVNMWQGVGRCMYAPPIKGNITCKSIITGLLLTRDGGNDDNDTETFRPGGGDMRDNWRSELYKYKVVEIKPLGIAPTECKRRVVGRRRRRRAVGIGAVFLGFLGAAGSTMGAASITLTVQARQLLSGIVQQQSNLLRAPEAQQHMLQLTVWGIKQLQTRVLAIERYLKDQQLLGIWGCSGKLICCTAVPWNISWSNKSVNDIWNNMTWMQWDREISNYTGIIYRLLEDSQIQQEENEKDLLALD

SEQ ID NO: 1573 - protein, 652 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVEIKPLGIAPTSCKRRVVGRRRRRRAAGIGAVILGFLGAAGSTMGAASVMLTVQARQLLSGIVQQQSNLLRAPEAQQHMLQLTVWGIKQLQTRVLAIERYLKDQQLLGLWGCSGKLICCTAVPWNTSWSNKSKDEIWDNMTWMQWDREIDNYTQVIYQLLEVSQNQQEKNENDLLALD

SEQ ID NO: 1574 - protein, 636 aa, Artificial Sequence
  Recombinant HIV protein
AENLWVTVYYGVPVWREAKTTLFCASDAKAYEKEVHNVWATHACVPTDPNPQELVLENVTENFNMWKNDMVNQMHEDIISLWDQSLKPCVKLTPLCVTLNCSNVNINETSIDFNVTSNISMKEEMKNCSFKVNSELRDKNRREHALFYKLDIVQLNDEGNDSYSYRLINCNTSTCKQACPKVSFEPIPIHYCAPAGYAILKCNNETFNGSGPCNNVSTVQCTHGIKPVVSTQLLLNGSLAEKEIMIRSENLTNNAKTIIVQLTEAVNITCMRPGNNTRRSVRIGPGQTFYATGEIIGDIRQAHCNISKDKWNQILQNVRAKLGEHFHDKTIKFEPSSGGDLEITTHSFNCGGEFFYCNTTNLFSRTYTNGSNSNVNITSATITLPCRIKQIINMWQEVGRCMYAPPIAGNITCISNITGLLLTRDGGNGNDTNDTETFRPAGGDMRDNWRSELYKYKVVEIKPLGIAPTKCKRRVVGRRRRRRAVGIGAVFLGFLGAAGSTMGAASITLTVQARQLLSGIVQQQNNLLRAPEAQQHLLQLTVWGIKQLQARVLAIERYLKDQQLLGLWGCSGKLICCTTVSWNSSWSNKSVDDIWQNMTWMQWDREINNYTEIIYRLLEVSQNQQEKNEEDLLALD

SEQ ID NO: 1575 - protein, 609 aa, Artificial Sequence
  Recombinant HIV protein
AENLWVTVYYGVPVWKEAKATLFCASDAKAQETEVHNIWATHACVPTDPNPQEMILENVTENFNMWKNDMVDQMHEDVISLWDQSLKPCIKLTPLCVTLNCTNATYNGSTIEDVRNCSFNATTEVKNKKQEVNALFNLLDIVPIKSSIYRLTNCNTSACTQACPKVTFDPIPIHYCAPAGYAILKCNNKTFNGKGPCNNVSTVQCTHGIKPVVSTQLLLNGSLAEEDIIIRSENLTNNVKTIIVHLKEPVEIVCTRPGNNTRKSVRIGPGQTFYATGAIIGDIRKAHCNISKKAWNDTLHKVEGKLRELYNKSIKFEPSSGGDLEITTHSFNCRGEFFYCNTTKLFHEGSRKNDNDTITLPCRIKQFINMWQEVGRCMYAPPIAGNITCNSSITGILLVRDGGTNNTNETFRPGGGDMRDNWRSELYKYKVVEIQPLGIAPTKCKRRVVGRRRRRRAVGLGAVFLGFLGAAGSTMGAASITLTAQARQLLSGIVQQQSNLLRAPEAQQHMLQLTVWGIKQLQARVLAIERYLQDQQLLGIWGCSGKLICCTAVPWNSSWSNRSQADIWENMTWMQWEKEISNYTNTIYWLLEDSQIQQEKNEKDLLALD

SEQ ID NO: 1576 - protein, 616 aa, Artificial Sequence
  Recombinant HIV protein
AENLWVTVYYGVPVWREAKTTLFCASDAKAYETEAHSVWATHACVPTDPNPQEMVLENVTENFNMWKNDMVDQMHEDVISIWDQSLKPCVKLTPLCVTLDCSTYNNTHNISKEMKICSFNMTTELRDKKRKVNVLFYKLDLVPLTNSSNTTNYRLISCNTSTCTQACPKVSFDPIPIHYCAPAGYAILKCNNKTFNGTGPCNNVSTVQCTHGIKPVVSTQLLLNGSLAEEEIIIRFENLTDNVKIIIVQLNETINITCTRPNNNTRKSIRIGPGQSFYATGEIVGNIREAHCNISASKWNKTLERVRTKLKEHFPNKTIEFEPSSGGDLEITTHSFNCGGEFFYCNTSGLFNSAINGTLTSNVTLPCRIKQIINMWQEVGRCMYAPPIAGNITCKSNITGLLLTRDGGENSSSTTETFRPTGGDMKNNWRSELYKYKVVEIKPLGIAPTECKRRVVGRRRRRRAVGIGAVFLGFLGAAGSTMGAASMTLTVQARQLLSGIVQQQSNLLKAPEAQQHMLQLTVWGIKQLQARVLAIERYLKDQQLLGLWGCSGKLICCTNVPWNASWSNKSKNDIWDNMTWMQWDREISNHTDTIYRLLEDSQNQQEKNEKDLLALD

SEQ ID NO: 1577 - protein, 629 aa, Artificial Sequence
  Recombinant HIV protein
AENLWVTVYYGVPVWREAKTTLFCASDAKAYEKEVHNVWVTHACVPTDPNPQEMNLENVTENFNMWKNDMVDQMHEDIISLWDQSLKPCVKLTPLCVTLNCNNVNVTHNSTYNNTEGEQIKNCSFNITTELRDKKQKVYALFYKLDILPLNGNNDSNEYRLINCNTSACTQACPKVSFDPIPIHYCAPAGYAILKCNNKTFNGKGPCNNVSTVQCTHGIKPVVSTQLLLNGSLAEKEIIIRSENITDNVKIIIVHLNESVEINCTRPNNNTRKSIRIGPGQTFYATGEIIGKIREAHCNISKEKWNKTLLRVAKKLREHFPGKAIKFEPSSGGDLEITTHSFNCRGEFFYCTTSKLFNSTYNPNDTESNSNNSNETLTLTCKIKQIINMWQGVGRCMYAPPIEGSITCNSTITGLLLTRDGGSKNNTEEIFRPGGGNMKDNWRSELYKYKVVEIKPLGVAPTECKRRVVGRRRRRRAVGLGAVFLGFLGAAGSTMGAASITLTVQARQLLSGIVQQQNNLLRAPEAQQHMLQLTVWGIKQLQARVLAIERYLKDQQLLGIWGCSGKLICCTSVPWNTSWSNKSKAEIWDNMTWMQWDKEISNYTQTIYNLLEESQSQQEKNEKDLLELD

SEQ ID NO: 1578 - protein, 616 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVEIKPLGIAPTKCKRRVVGRRRRRRAVGLGAMFLGFLGAAGSTMGAASITLTVQARQLLSGIVQQQNNLLRAPEAQQHMLQLTVWGIKQLQARVLAIERYLKDQQLLGLWGCSGKLVCCTAVPWNSSWSNKSQEDIWNNTTWMQWDKEVSNYTKTIYKLLEKSQNQQEENEKDLLALD

SEQ ID NO: 1579 - protein, 621 aa, Artificial Sequence; identical to SEQ ID NO: 1077
  Recombinant HIV protein

SEQ ID NO: 1580 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSWRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1581 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSWRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1582 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGQAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1583 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNATTELRDKKKKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1584 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNATTELRDKKKKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGQAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1585 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGQAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1586 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNATTELRDKKKKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1587 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNATTELRDKKKKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGQAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1588 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVCLNCKDVNATNTTNDSEGTMERGEIKNCSFNITTSIRCKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1589 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCCTLNCKDVNATNTTNDSEGTMERGEIKNCSFNITTSIRCKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1590 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVCLNCKDVNATNTTNDSEGTMERGEIKNCSFNITTSIRCKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1591 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCCTLNCKDVNATNTTNDSEGTMERGEIKNCSFNITTSIRCKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1592 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSCRDKVQKEYALFYKLDVVPIDNNNTSYRLISSDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1593 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSCRDKVQKEYALFYKLDVVPIDNNNTSYRLISFDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1594 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSCRDKVQKEYALFYKLDVVPIDNNNTSYRLISLDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1595 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSCRDKVQKEYALFYKLDVVPIDNNNTSYRLISSDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1596 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSCRDKVQKEYALFYKLDVVPIDNNNTSYRLISFDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1597 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSCRDKVQKEYALFYKLDVVPIDNNNTSYRLISLDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1598 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTCKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPICGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1599 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYCLFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYCTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1600 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTCIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSICIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1601 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIICLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLCRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1602 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIICLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLCRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1603 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWCQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRCPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1604 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWCQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRCPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1605 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPWAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1606 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPFAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1607 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVFLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPWAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1608 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVFLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPFAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1609 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVWLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPWAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1610 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVWLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPFAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1611 - protein, 658 aa, Artificial Sequence
  Recombinant HIV protein
MPMGSLQPLATLYLLGMLVASVLAAENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGCAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1612 - protein, 658 aa, Artificial Sequence
  Recombinant HIV protein
MPMGSLQPLATLYLLGMLVASVLAAENLWVTVYYGVPVWKDAETTLFCASDAKAYETEKHNVWATHACVPTDPNPQEIHLENVTEEFNMWKNNMVEQMHTDIISLWDQSLKPCCKLTPLCVTLQCTNVTNNITDDMRGELKNCSFNMTTELRDKKQKVYSLFYRLDVVQINENQGNRSNNSNKEYRLINCNTSAITQACPKVSFEPIPIHYCAPAGFAILKCKDKKFNGTGPCPSVSTVQCTHGIKPVVSTQLLLNGSLAEEEVMIRSENITNNAKNILVQFNTPVQINCTRPNNNTRKSIRIGPGQAFYATGDIIGDIRQAHCNVSKATWNETLGKVVKQLRKHFGNNTIIRFANSSGGDLEVTTHSFNCGGEFFYCNTSGLFNSTWISNTSVQGSNSTGSNDSITLPCRIKQIINMWQRIGQAMYAPPIQGVIRCVSNITGLILTRDGGSTNSTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1613 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGCAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1614 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCCKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1615 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKAKRRVVGRRRRRRAVGIGAVFLGFLGAAGSTMGAASMTLTVQARLLLSGIVQQQNNLLRAIEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELD

SEQ ID NO: 1616 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1617 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKPMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1618 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGPAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1619 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYCLFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYCTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1620 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLICCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1621 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTCVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1622 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTCKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPICGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1623 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGWAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1624 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGYDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1625 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVPKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1626 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIICMWQEVGKCMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1627 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCCKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGCAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1628 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKCTPLCVTLNCKDVNATNTTNDSEGTMERGEIKNCSFNITTSIRDKVQKEYALFYKLDVVPIDNNNTSYRLISCDTSVITCACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1629 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTCKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPICGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1630 - protein, 652 aa, Artificial Sequence; identical to SEQ ID NO: 1622
  Recombinant HIV protein

SEQ ID NO: 1631 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITCACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRACYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1632 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKCTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRACYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1633 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFCTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYACPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1634 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKCYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSCHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1635 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACCKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFCTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1636 - protein, 652 aa, Artificial Sequence; identical to SEQ ID NO: 1619
  Recombinant HIV protein

SEQ ID NO: 1637 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTCIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSICIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1638 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYACFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTCGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1639 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTCGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPCIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1640 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKCKRRVVGRRRRRRAVGIGAVFLGFLGAAGSTMGAASMTLTVQARLLLSGIVQQQNNLLRAIEAQQRMLQLTVWGIKQLQARVLAVERYLGDQQLLGIWGCSGKLICCTAVPWNASWSNKSLDRIWNNMTWMEWEREIDNYTSEIYTLIEESQNQQEKNEQELLELD

SEQ ID NO: 1641 - protein, 652 aa, Artificial Sequence
  Recombinant HIV protein
MPMGSLQPLATLYLLGMLVASVLAVEKLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKAMYAPPIRGQIRCSSNITGLLLTRDGGINENGTEIFRPGGGDMRDNWRSELYKYKVVKIEPLGVAPTKAKRRVVGRRRRRRAVGIGAVFLGFLGAAGSTMGAASMTLTVQARLLLSGIVQQQNNLLRAPEAQQRMLQLTVWGIKQLQARVLAVERYLGDQQLLGIWGCSGKLICTTAVPWNASWSNKSLDRIWNNMTWMEWEREIDNYTSEIYTLIEESQNQQEKNEQELLELD

SEQ ID NO: 1642 - protein, 652 aa, Artificial Sequence; identical to SEQ ID NO: 1615
  Recombinant HIV protein

SEQ ID NO: 1643 - protein, 632 aa, Artificial Sequence
  Recombinant HIV protein
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1644 - protein, 623 aa, Artificial Sequence
  Recombinant HIV protein
AENLWVTVYYGVPVWKDAETTLFCASDAKAYEKEKHNVWATHACVPTDPNPQEMVLKNVTENFNMWKNDMVDQMHTDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQRVGQAMYAPPIAGNITCISNITGLLLTRDGGKNNTETFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEK

SEQ ID NO: 1645 - protein, 643 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENIANNAKNILVQFNTPVQINCTRPNNNTRKSIRIGPGQAFYATGDIIGDIRQAHCNVSKATWNETLGKVVKQLRKHFGNNTIIRFANSAGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSATETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1646 - protein, 643 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTAACTQACPKVSFEPIPIHYCAPAGFAILKCKDKKFNGTGPCPSVSTVQCTHGIKPVVSTQLLLNGSLAEEEVMIRSENIANNAKNILVQFNTPVQINCTRPNNNTRKSIRIGPGQAFYATGDIIGDIRQAHCNVSKATWNETLGKVVKQLRKHFGNNTIIRFANSAGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSATETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1647 - protein, 643 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTAACTQACPKVSFEPIPIHYCAPAGFAILKCKDKKFNGTGPCPSVSTVQCTHGIKPVVSTQLLLNGSLAEEEVMIRSENIANNAKNILVQFNTPVQINCTRPNNNTRKSIRIGPGQAFYATGDIIGDIRQAHCNVSKATWNETLGKVVKQLRKHFGNNTIIRFANSAGGDLEVTTHSFNCGGEFFYCNTAGLFNSTWISNTSVQGSNSTGSNDSITLPCRIKQIINMWQRIGQCMYAPPIQGVIRCVSNITGLILTRDGGSTNSATETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1648 - protein, 630 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLANNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTADNGAEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1649 - protein, 630 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTATCTQACPKVSFDPIPIHYCAPAGYAILKCNNKTFNGLGPCNNVSTVQCTHGIKPVVSTQLLLNGSLAEEEIIIRSENLANNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTADNGAEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1650 - protein, 630 aa, Artificial Sequence; identical to SEQ ID NO: 1649
  Recombinant HIV protein

SEQ ID NO: 1651 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTSACTQACPKVSFEPIPIHYCAPAGFAILKCKDKKFNGTGPCPSVSTVQCTHGIKPVVSTQLLLNGSLAEEEVMIRSENIANNAKNILVQFNTPVQINCTRPNNNTRKSIRIGPGQAFYATGDIIGDIRQAHCNVSKATWNETLGKVVKQLRKHFGNNTIIRFANSAGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSATETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1652 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTAACTQACPKVSFEPIPIHYCAPAGFAILKCKDKKFNGTGPCPSVSTVQCTHGIKPVVSTQLLLNGSLAEEEVMIRSENIANNAKNILVQFNTPVQINCTRPNNNTRKSIRIGPGQAFYATGDIIGDIRQAHCNVSKATWNETLGKVVKQLRKHFGNNTIIRFANSAGGDLEVTTHSFNCGGEFFYCNTSGLFNSTWISNTSVQGSNSTGSNDSITLPCRIKQIINMWQRIGQCMYAPPIQGVIRCVSNITGLILTRDGGSTNSATETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1653 - protein, 634 aa, Artificial Sequence
  Recombinant HIV protein
AENLWVTVYYGVPVWKDAETTLFCASDAKAYETEKHNVWATHACVPTDPNPQEIHLENVTEEFNMWKNNMVEQMHTDIISLWDQSLKPCVKLTPLCVTLQCTNVTNNITDDMRGELKNCSFNMTTELRDKKQKVYSLFYRLDVVQINENQGNRSNNSNKEYRLINCNTAACTQACPKVSFEPIPIHYCAPAGFAILKCKDKKFNGTGPCPSVSTVQCTHGIKPVVSTQLLLNGSLAEEEVMIRSENIANNAKNILVQFNTPVQINCTRPNNNTRKSIRIGPGQAFYATGDIIGDIRQAHCNVSKATWNETLGKVVKQLRKHFGNNTIIRFANSAGGDLEVTTHSFNCGGEFFYCNTAGLFNSTWISNTSVQGSNSTGSNDSITLPCRIKQIINMWQRIGQCMYAPPIQGVIRCVSNITGLILTRDGGSTNSATETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1654 - protein, 623 aa, Artificial Sequence
  Recombinant HIV protein
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVCTQACPKVSFDPIPIHYCAPAGYAILKCNNKTFTGTGPCNNVSTVQCTHGIKPVVSTQLLLNGSLAEGEIIIRSENIANNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRCMYAPPIAGNITCISNITGLLLTRDGGKNNAETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1655 - protein, 623 aa, Artificial Sequence
  Recombinant HIV protein
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTAVCTQACPKVSFDPIPIHYCAPAGYAILKCNNKTFTGTGPCNNVSTVQCTHGIKPVVSTQLLLNGSLAEGEIIIRSENIANNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRCMYAPPIAGNITCISNITGLLLTRDGGKNNAETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1656 - protein, 623 aa, Artificial Sequence
  Recombinant HIV protein
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTAVCTQACPKVSFDPIPIHYCAPAGYAILKCNNKTFTGTGPCNNVSTVQCTHGIKPVVSTQLLLNGSLAEGEIIIRSENIANNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTASLFNRTYMANSTDMANSTETNSTRTITIHCRIKQIINMWQEVGRCMYAPPIAGNITCISNITGLLLTRDGGKNNAETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1657 - protein, 621 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLANNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTADNGAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1658 - protein, 621 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTATCTQACPKVSFDPIPIHYCAPAGYAILKCNNKTFNGLGPCNNVSTVQCTHGIKPVVSTQLLLNGSLAEEEIIIRSENLANNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTADNGAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1659 - protein, 621 aa, Artificial Sequence; identical to SEQ ID NO: 1658
  Recombinant HIV protein

SEQ ID NO: 1660 - protein, 630 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLADNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDAETFRPGGGDMKNNWRSELYKYKVVEIKPLGVAPTECKRRVVGRRRRRRAVGIGAVLLGFLGAAGSTMGAASITLTAQARQVLSGIVQQQSNLLRAPEAQQHLLQLTVWGIKQLQTRVLALERYLKDQQLLGLWGCSGRLICCTAVPWNSSWSNKSLTDIWDNMTWMQWDKEVSNYTNTIYRLLEDSQSQQEKNEKDLLALD

SEQ ID NO: 1661 - protein, 630 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTAACTQACPKVSFDPIPIHYCAPAGYAILKCNNKTFNGTGPCYNVSTVQCTHGIKPVVSTQLLLNGSLAEGEIIIRSENLADNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDAETFRPGGGDMKNNWRSELYKYKVVEIKPLGVAPTECKRRVVGRRRRRRAVGIGAVLLGFLGAAGSTMGAASITLTAQARQVLSGIVQQQSNLLRAPEAQQHLLQLTVWGIKQLQTRVLALERYLKDQQLLGLWGCSGRLICCTAVPWNSSWSNKSLTDIWDNMTWMQWDKEVSNYTNTIYRLLEDSQSQQEKNEKDLLALD

SEQ ID NO: 1662 - protein, 630 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTAACTQACPKVSFDPIPIHYCAPAGYAILKCNNKTFNGTGPCYNVSTVQCTHGIKPVVSTQLLLNGSLAEGEIIIRSENLADNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTAKLFNSTYMHNATSRNATNATITLPCRIRQIINMWQEVGRCMYAPPIAGNITCVSNITGLLLVRDGGNGDTNDAETFRPGGGDMKNNWRSELYKYKVVEIKPLGVAPTECKRRVVGRRRRRRAVGIGAVLLGFLGAAGSTMGAASITLTAQARQVLSGIVQQQSNLLRAPEAQQHLLQLTVWGIKQLQTRVLALERYLKDQQLLGLWGCSGRLICCTAVPWNSSWSNKSLTDIWDNMTWMQWDKEVSNYTNTIYRLLEDSQSQQEKNEKDLLALD

SEQ ID NO: 1663 - protein, 634 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLADNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNEANDAETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1664 - protein, 634 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTAACTQACPKVTFDPIPIHYCAPAGYAILKCNDTKFNGTGPCHNVSTVQCTHGIKPVVSTQLLLNGSLAEEEIMIRSENLADNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNEANDAETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1665 - protein, 634 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTAACTQACPKVTFDPIPIHYCAPAGYAILKCNDTKFNGTGPCHNVSTVQCTHGIKPVVSTQLLLNGSLAEEEIMIRSENLADNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTAGLFNGTYMPNGTKINDTERNLSSTITIPCRIKQIINMWQGVGQCMYAPPIKGNIACKSNITGLLLTRDGGRSNEANDAETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1666 - protein, 630 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLADNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDAETFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1667 - protein, 630 aa, Artificial Sequence; identical to SEQ ID NO: 1661
  Recombinant HIV protein

SEQ ID NO: 1668 - protein, 630 aa, Artificial Sequence; identical to SEQ ID NO: 1666
  Recombinant HIV protein

SEQ ID NO: 1669 - protein, 634 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLANNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNEAEIFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1670 - protein, 634 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTAACTQACPKVTFDPIPIHYCAPAGYAILKCNNKTFNGTGPCNNVSTVQCTHGIKPVVSTQLLLNGSLAEGEIIIRSENLANNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNEAEIFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1671 - protein, 634 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTAACTQACPKVTFDPIPIHYCAPAGYAILKCNNKTFNGTGPCNNVSTVQCTHGIKPVVSTQLLLNGSLAEGEIIIRSENLANNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTASLFNSTYNPNDANSNSSSSNSSLDITIPCRIKQIINMWQEVGRCMYAPPIEGNITCKSNITGLLLVRDGGVESNEAEIFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1672 - protein, 635 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLNCTDYLGNATNTTSSSGGAMEGGEIKNCSFNITTSMRDKMQKEYALFYKLDVVSIDNDNASTNYRLISCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQASGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1673 - protein, 635 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLNCTDYLGNATNTTSSSGGAMEGGEIKNCSFNITTSMRDKMQKEYALFYKLDVVSIDNDNASTNYRLISCNTAVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQASGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1674 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1675 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1676 - protein, 619 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTTTVIRDKIQKEYALFYKLDIVPIEGKNTNTGYRLINCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1677 - protein, 619 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTTTVIRDKIQKEYALFYKLDIVPIEGKNTNTGYRLINCNTSTCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1678 - protein, 611 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLDCSTYNNTHNISKEMKICSFNMTTELRDKKRKVNVLFYKLDLVPLTNSSNTTNYRLISCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1679 - protein, 611 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLDCSTYNNTHNISKEMKICSFNMTTELRDKKRKVNVLFYKLDLVPLTNSSNTTNYRLISCNTSTCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1680 - protein, 633 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1681 - protein, 633 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQASGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1682 - protein, 633 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTAVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQASGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1683 - protein, 625 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1684 - protein, 625 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQASGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1685 - protein, 625 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTAVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQASGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1686 - protein, 618 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTTTVIRDKIQKEYALFYKLDIVPIEGKNTNTGYRLINCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1687 - protein, 619 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLHCTNVTISSTNGSTANVTMREEMKNCSFNTTTVIRDKIQKEYALFYKLDIVPIEGKNTNTGYRLINCNTSTCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1688 - protein, 611 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLDCSTYNNTHNISKEMKICSFNMTTELRDKKRKVNVLFYKLDLVPLTNSSNTTNYRLISCNTATCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1689 - protein, 611 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLDCSTYNNTHNISKEMKICSFNMTTELRDKKRKVNVLFYKLDLVPLTNSSNTTNYRLISCNTSTCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1690 - protein, 633 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1691 - protein, 633 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQASGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1692 - protein, 633 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLHCTNVTISSTNGSTANVTMREEMKNCSFNTTTVIRDKIQKEYALFYKLDIVPIEGKNTNTGYRLINCNTAVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQASGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1693 - protein, 625 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQSSGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1694 - protein, 625 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTSVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQASGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1695 - protein, 625 aa, Artificial Sequence
  Recombinant HIV protein
AENLWVTVYYGVPVWKEATATLFCASDAKAYETEVHNVWATHACVPTDPNPQEVVLENVTENFNMWKNNMVEQMHEDIISLWDQSLKPCVKLTPLCVTLDCSTYNNTHNISKEMKICSFNMTTELRDKKRKVNVLFYKLDLVPLTNSSNTTNYRLISCNTAVCTQACPKISFEPIPIHYCAPAGFAILKCNDKKFNGTGPCTNVSTVQCTHGIRPVVSTQLLLNGSLAEEEIVIRSENIKDNAKIIIVQLNETVEINCTRPNNNTRKSIPIGPGRAFYTTGAIIGDIRQAHCNISKAKWENTLKQIARKLREHFKNETIAFNQASGGDPEIVMHSFNCGGEFFYCNSTQLFNSTWTWNDTEVVNNTEKNINITLPCRIKQIINMWQEVGKCMYAPPIKGQIRCSSNITGLLLTRDGGSSTNGTTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1696 - protein, 617 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLNCINANVTNSSMTNSSMMEGEIKNCSYNMTTELRDKKRKVFSLFYKLDVVPMNENNSEYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1697 - protein, 619 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLKCKDVSINNGNVSSSNGSTSHNNSSIDNETLNEGMKEMKNCSFNATTVLRDKKQKVHALFYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1698 - protein, 612 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLDCSTYNNTHNISKEMKICSFNMTTELRDKKRKVNVLFYKLDLVPLTNSSNTTNYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1699 - protein, 613 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLHCTNVTSVNTTGDREGLKNCSFNMTTELRDKRQKVYSLFYRLDIVPINENQGSEYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1700 - protein, 629 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLHCTNANLTKANLTNVNNRTNVSNIIGNITDEVRNCSFNMTTELRDKKQKVHALFYKLDIVPIEDNNDNSKYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1701 - protein, 620 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLHCTNVTISSTNGSTANVTMREEMKNCSFNTTTVIRDKIQKEYALFYKLDIVPIEGKNTNTGYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1702 - protein, 618 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLNCSDAKVNINATYNGTREEIKNCSFNATTELRDKKKKEYALFYRLDIVPLNKEGNNNSEYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1703 - protein, 615 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLDCQAFNSSSHTNSSIAMQEMKNCSFNVTTELRDKKKKEYSFFYKTDIEQINKNGRQYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1704 - protein, 615 aa, Artificial Sequence
  Recombinant HIV protein
AENLWVTVYYGVPVWKEAKTTLFCASDAKSYEREVHNVWATHACVPTDPDPQELVMANVTENFNMWKNDMVDQMHEDIISLWDQSLKPCVKLTPLCVTLECRNITGVNISEGKEEIKNCSFNITTELRDKRKKVYSLFYRLDVVQIDEGDKNSTQYRLISCNTSTCTQACPKVSFDPIPIHYCAPAGYAILKCNNKTFSGKGPCSNVSTVQCTHGIRPVVSTQLLLNGSLAEEEIVIRSENLTDNAKTIIVHLNKSVEIECIRPGNNTRKSIRLGPGQTFYATGDVIGDIRKAYCKINGSEWNETLTKVSEKLKEYFNKTIRFAQHSGGRLEVTTHSFNCRGEFFYCNTSELFNSNATESNITLPCRIKQIINMWQGVGRCMYAPPIRGEIKCTSNITGLLLTRDGGNNNNSTEEIFRPEGGNMRDNWRSELYKYKVVKIEPLGVAPTRCKRNVTGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLNATD

SEQ ID NO: 1705 - protein, 628 aa, Artificial Sequence; identical to SEQ ID NO: 764
  Recombinant HIV protein

SEQ ID NO: 1706 - protein, 628 aa, Artificial Sequence; identical to SEQ ID NO: 767
  Recombinant HIV protein

SEQ ID NO: 1707 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKNLSDNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGNTTNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1708 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGNTANNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1709 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGNTTNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1710 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1711 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTTNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1712 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFDITTEIRDKTRKEYALFYRLDIVPLDNSSNPNSSNTYRLINCNTSTCTQACPKVTFDPIPIHYCAPAGYAILKCNNKTFNGKGPCNNVSTVQCTHGIKPVVSTQLLLNGSLAEEEIVIRSKNLSDNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTTNNTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1713 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFNATTELRDKKKKEYALFYRLDIVPLDNSSNPNSSNTYRLINCNTSTLTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKAIYAPPIKGNITCKSDITGLLLLRDGGNTANNAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1714 - protein, 626 aa, Artificial Sequence
  Recombinant HIV protein
AENLWVTVYYGVPVWKEAKTTLFCASDAKAYEKEVHNVWATHACVPTDPNPQEVVLENVTENFNMWKNDMVDQMQEDVISIWDQSLKPCVKLTPLCVTLNCTNVNVTSNSTNVNSSSTDNTTLGEIKNCSFNATTELRDKKKKEYALFYRLDIVPLDNSSNPNSSNTYRLINCNTSTCTQACPKVTFDPIPIHYCAPAGYAILKCNNKTFNGKGPCNNVSTVQCTHGIKPVVSTQLLLNGSLAEEEIVIRSKNLADNAKIIIVQLNKSVEIVCTRPNNNTRRSIRIGPGQTFYATDIIGDIRQAYCNISGRNWSEAVNQVKKKLKEHFPHKNISFQSSSGGDLEITTHSFNCGGEFFYCNTSGLFNDTISNATIMLPCRIKQIINMWQEVGKCIYAPPIKGNITCKSDITGLLLLRDGGNTANNAEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1715 - protein, 623 aa, Artificial Sequence
  Recombinant HIV protein
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1716 - protein, 623 aa, Artificial Sequence
  Recombinant HIV protein
AENLWVTVYYGVPVWKDAETTLFCASDAKAYEKEVHNVWATHACVPTDPNPQEIHLENVTENFNMWKNNMVEQMHTDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGFAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1717 - protein, 623 aa, Artificial Sequence
  Recombinant HIV protein
AENLWVTVYYGVPVWKEAKTTLFCASDAKAYEKEVHNVWATHACVPTDPNPQEMVLKNVTENFNMWKNDMVDQMHEDVISLWDQSLKPCVKLTPLCVTLNCTNVTASNSSIIEGMKNCSFNITTELRDKKEKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQEVGRAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1718 - protein, 623 aa, Artificial Sequence
  Recombinant HIV protein
AENLWVTVYYGVPVWKEAETTLFCASDAKAYETEVHNVWATHACVPTDPNPQEIHLENVTENFNMWKNNMVEQMHEDVISLWDQSLKPCVKLTPLCVTLQCTNVTASNSSMRGEMKNCSFNMTTELRDKKEKVYALFYRLDVVQINGNNKEYRLINCNTSVITQACPKVSFEPIPIHYCAPAGFAILKCNNKKFNGTGPCPNVSTVQCTHGIKPVVSTQLLLNGSLAEEEVMIRSENITNNAKTIIVQLNESVQINCTRPNNKTRKSIRIGPGQAFYATGQIIGDIRQAHCNVSKATWNETLGKVVKKLRKHFPHTNIRFANSSGGDLEVTTHSFNCGGEFFYCNTSGLFNSTYMANSTDMANSTETNSNDSITIHCRIKQIINMWQRVGQAMYAPPIQGVIRCVSNITGLLLTRDGGSTNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1719 - protein, 623 aa, Artificial Sequence
  Recombinant HIV protein
AENLWVTVYYGVPVWKEAETTLFCASDAKAYEKEVHNVWATHACVPTDPNPQEMVLKNVTENFNMWKNDMVDQMHEDVISLWDQSLKPCVKLTPLCVTLNCTNVTASNSSMRGGMKNCSFNITTELRDKKEKKNALFYKLDIVQLDGNNSEYRLINCNTSVITQACPKVSFEPIPIHYCAPAGFAILKCNNKTFTGTGPCNNVSTVQCTHGIKPVVSTQLLLNGSLAEGEIIIRSENITNNAKTIIVHLNESVQIECTRPNNKTRTSIRIGPGQAFYATGQVIGDIREAYCNINEAKWNETLQRVSKKLKEHFPHKNIRFANSSGGDLEITTHSFNCGGEFFYCNTSSLFNSTYMANSTDMANSTETNSTRTITIHCRIKQIINMWQEVGQAMYAPPIAGVIRCVSNITGLLLTRDGGKNNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1720 - protein, 623 aa, Artificial Sequence
  Recombinant HIV protein
AENLWVTVYYGVPVWKDAETTLFCASDAKAYEKEKHNVWATHACVPTDPNPQEMVLKNVTENFNMWKNDMVDQMHTDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQRVGQAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1721 - protein, 623 aa, Artificial Sequence
  Recombinant HIV protein
AENLWVTVYYGVPVWKDAETTLFCASDAKAYEKEKHNVWATHACVPTDPNPQEMVLKNVTENFNMWKNDMVDQMHTDVISLWDQSLKPCVKLTPLCVTLNCTNVTASNSSIIEGMKNCSFNITTELRDKKEKKNALFYKLDIVQLDGNSSQYRLINCNTSVITQACPKVSFDPIPIHYCAPAGYAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQRVGQAMYAPPIAGNITCISNITGLLLTRDGGKNNTETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1722 - protein, 623 aa, Artificial Sequence
  Recombinant HIV protein
AENLWVTVYYGVPVWKDAETTLFCASDAKAYETEKHNVWATHACVPTDPNPQEIHLENVTENFNMWKNNMVEQMHTDVISLWDQSLKPCVKLTPLCVTLQCTNVTASNSSMRGEMKNCSFNMTTELRDKKEKVYALFYRLDVVQINGNNKEYRLINCNTSVITQACPKVSFEPIPIHYCAPAGFAILKCNNKKFNGTGPCPNVSTVQCTHGIKPVVSTQLLLNGSLAEEEVMIRSENITNNAKTIIVQLNESVQINCTRPNNKTRKSIRIGPGQAFYATGQIIGDIRQAHCNVSKATWNETLGKVVKKLRKHFPHTNIRFANSSGGDLEVTTHSFNCGGEFFYCNTSGLFNSTYMANSTDMANSTETNSNDSITIHCRIKQIINMWQRVGQAMYAPPIQGVIRCVSNITGLLLTRDGGSTNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1723 - protein, 623 aa, Artificial Sequence
  Recombinant HIV protein
AENLWVTVYYGVPVWKDAETTLFCASDAKAYEKEKHNVWATHACVPTDPNPQEMVLKNVTENFNMWKNDMVDQMHTDVISLWDQSLKPCVKLTPLCVTLNCTNVTASNSSMRGGMKNCSFNITTELRDKKEKKNALFYKLDIVQLDGNNSEYRLINCNTSVITQACPKVSFEPIPIHYCAPAGFAILKCNNKTFTGTGPCNNVSTVQCTHGIKPVVSTQLLLNGSLAEGEIIIRSENITNNAKTIIVHLNESVQIECTRPNNKTRTSIRIGPGQAFYATGQVIGDIREAYCNINEAKWNETLQRVSKKLKEHFPHKNIRFANSSGGDLEITTHSFNCGGEFFYCNTSSLFNSTYMANSTDMANSTETNSTRTITIHCRIKQIINMWQRVGQAMYAPPIAGVIRCVSNITGLLLTRDGGKNNTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1724 - protein, 623 aa, Artificial Sequence
  Recombinant HIV protein
AENLWVTVYYGVPVWKDAETTLFCASDAKAYEKEKHNVWATHACVPTDPNPQEIHLENVTENFNMWKNNMVEQMHTDVISLWDQSLKPCVKLTPLCVTLNCTNATASNSSIIEGMKNCSFNITTELRDKREKKNALFYKLDIVQLDGNSSQYRLINCNTSVITQACPKVSFDPIPIHYCAPAGFAILKCNNKTFTGTGPCNNVSTVQCTHGIKPVVSTQLLLNGSLAEGEIIIRSENITNNVKTIIVHLNESVKIECTRPNNKTRTSIRIGPGQAFYATGQVIGDIREAYCNINESKWNETLQRVSKKLKEYFPHKNITFQPSSGGDLEITTHSFNCGGEFFYCNTSSLFNRTYMANSTDMANSTETNSTRTITIHCRIKQIINMWQRVGQAMYAPPIAGNITCISNITGLLLTRDGGKNNTETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1725 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1726 - protein, 628 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1727 - protein, 636 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGELKNCSFNMTTELRDKKQKVYSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1728 - protein, 622 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLQCTNVTNNITDDMRGEIKNCSFNITTSIRDKVQKEYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1729 - protein, 622 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1730 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKKQKVYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1731 - protein, 628 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITTSIRDKKQKVYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1732 - protein, 636 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGELKNCSFNMTTELRDKKQKVYSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1733 - protein, 622 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLQCTNVTNNITDDMRGEIKNCSFNITTSIRDKKQKVYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1734 - protein, 622 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGEIKNCSFNITTSIRDKKQKVYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1735 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1736 - protein, 628 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITTSIRDKKQKVYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1737 - protein, 636 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGELKNCSFNMTTELRDKKQKVYSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1738 - protein, 628 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITTSIRDKVQKEYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1739 - protein, 622 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1740 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKKQKVYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1741 - protein, 628 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1742 - protein, 636 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGELKNCSFNMTTELRDKKQKVYSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1743 - protein, 622 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLQCTNVTNNITDDMRGEIKNCSFNITTSIRDKKQKVYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1744 - protein, 622 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGEIKNCSFNITTSIRDKKQKVYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1745 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1746 - protein, 628 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITTSIRDKVQKEYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1747 - protein, 630 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1748 - protein, 622 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLQCTNVTNNITDDMRGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1749 - protein, 622 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGEIKNCSFNITTSIRDKVQKEYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1750 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKKQKVYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1751 - protein, 628 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITTSIRDKKQKVYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1752 - protein, 630 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1753 - protein, 622 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLQCTNVTNNITDDMRGEIKNCSFNITTSIRDKKQKVYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1754 - protein, 622 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGEIKNCSFNITTSIRDKKQKVYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1755 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKKQKVYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1756 - protein, 622 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLQCTNVTNNITDDMRGEIKNCSFNITTSIRDKVQKEYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1757 - protein, 630 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIHIGPGRAFYTTGEIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1758 - protein, 622 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLQCTNVTNNITDDMRGEIKNCSFNITTSIRDKVQKEYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1759 - protein, 622 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGEIKNCSFNITTSIRDKVQKEYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1760 - protein, 628 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLNCKDVNATNTTNDSEGTMERGEIKNCSFNITTSIRDKVQKEYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1761 - protein, 628 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLNCKDVNATNTTNDSEGTMERGEIKNCSFNITTSIRDKKQKVYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1762 - protein, 630 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGELKNCSFNMTTELRDKKQKVYSLFYRLDVVQINENQGNRSNNSNKEYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1763 - protein, 622 aa, Artificial Sequence
  Recombinant HIV protein
AENLWVTVYYGVPVWKEATTTLFCASDAKAYDTEVHNVWATHACVPTDPNPQEVVLENVTEHFNMWKNNMVEQMQEDIISLWDQSLKPCVKLTPLCVTLQCTNVTNNITDDMRGEIKNCSFNITTSIRDKKQKVYALFYKLDVVPIDNNNTSYRLISCDTSVCTQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1764 - protein, 622 aa, Artificial Sequence
  Recombinant HIV protein
AENLWVTVYYGVPVWKDAETTLFCASDAKAYDTEVHNVWATHACVPTDPNPQEIHLENVTEHFNMWKNNMVEQMQTDIISLWDQSLKPCVKLTPLCVTLQCTNVTNNITDDMRGEIKNCSFNITTSIRDKKQKVYALFYKLDVVPIDNNNTSYRLINCNTSAITQACPKISFEPIPIHYCAPAGFAILKCNDKTFNGKGPCKNVSTVQCTHGIRPVVSTQLLLNGSLAEEEVVIRSDNFTNNAKTIIVQLKESVEINCTRPNNNTRKSIRIGPGQAFYATGDIIGDIRQAHCNISRAKWNDTLKQIVIKLREQFENKTIVFNHSSGGDPEIVMHSFNCGGEFFYCNSTQLFNSTWNNNTEGSNNTEGNTITLPCRIKQIINMWQEVGKCMYAPPIRGQIRCSSNITGLLLTRDGGINENGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALD

SEQ ID NO: 1765 - protein, 669 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1766 - protein, 667 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1767 - protein, 677 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQAMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1768 - protein, 690 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1769 - protein, 668 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSAITQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRAMYAPPIAGNITCVSNITGLLLVRDGGNGDTNDTETFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1770 - protein, 654 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1771 - protein, 689 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQAMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1772 - protein, 657 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVIKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQAMYAPPISGAINCLSNITGILLTRDGGGNNRSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1773 - protein, 679 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1774 - protein, 668 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1775 - protein, 668 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1776 - protein, 688 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1777 - protein, 672 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1778 - protein, 681 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1779 - protein, 671 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTITQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRAMYAPPIPGRITCNSSITGLILTRDGGENTTDNGTEIFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1780 - protein, 666 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1781 - protein, 686 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSAITQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQAMYAPPIPGVISCVSNITGLLLTRDGGGNNNTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1782 - protein, 702 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1783 - protein, 684 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1784 - protein, 664 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1785 - protein, 664 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1786 - protein, 674 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1787 - protein, 668 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1788 - protein, 676 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1789 - protein, 668 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1790 - protein, 663 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1791 - protein, 665 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1792 - protein, 663 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1793 - protein, 682 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1794 - protein, 653 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1795 - protein, 665 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1796 - protein, 673 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1797 - protein, 664 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1798 - protein, 668 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1799 - protein, 655 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1800 - protein, 670 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1801 - protein, 684 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1802 - protein, 650 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1803 - protein, 686 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1804 - protein, 664 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1805 - protein, 676 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1806 - protein, 686 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1807 - protein, 680 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1808 - protein, 688 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1809 - protein, 680 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1810 - protein, 675 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1811 - protein, 677 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1812 - protein, 675 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1813 - protein, 694 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1814 - protein, 665 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1815 - protein, 677 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1816 - protein, 685 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1817 - protein, 676 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1818 - protein, 680 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1819 - protein, 667 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1820 - protein, 682 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1821 - protein, 696 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1822 - protein, 662 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1823 - protein, 698 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1824 - protein, 676 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1825 - protein, 783 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1826 - protein, 793 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1827 - protein, 787 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1828 - protein, 795 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1829 - protein, 787 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1830 - protein, 782 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1831 - protein, 784 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1832 - protein, 782 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1833 - protein, 801 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1834 - protein, 772 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1835 - protein, 784 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1836 - protein, 792 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1837 - protein, 783 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1838 - protein, 787 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1839 - protein, 774 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1840 - protein, 789 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1841 - protein, 803 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1842 - protein, 769 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1843 - protein, 805 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1844 - protein, 783 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRCKRRVVGRRRRRRAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1845 - protein, 678 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVITQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKAMYAPPISGQIRCSSNITGLLLTRDGGRGNQTDNQTEIFRPVGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1846 - protein, 672 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSAITQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQAMYAPPIKGNIACKSNITGLLLTRDGGRSNETNDTETFRPEGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1847 - protein, 680 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVITQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKAMYAPPIKGQISCSSNITGLLLTRDGGNNNSSGPETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1848 - protein, 672 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSAITQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRAIYAPPIPGVVKCKSNITGLILTRDGGDDENNTETFRPGGGNMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1849 - protein, 669 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQAMYAPPIQGVIRCQSNITGILLTRDGGNTGNNSRTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1850 - protein, 667 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSAITQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQAIYAPPIQGEIRCVSNITGLLLTRDGGNNNGTSETFRPEGGNMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1851 - protein, 659 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTITQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRAMYAPPIPGRITCNSSITGLILTRDGGENTTDNGTEIFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1852 - protein, 674 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSAITQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQAMYAPPIAGNITCSSNITGLLLERDGGRDINNTEIFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1853 - protein, 688 aa, Artificial Sequence; identical to SEQ ID NO: 1776
  Recombinant HIV protein

SEQ ID NO: 1854 - protein, 680 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSAITQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRAMYAPPIAGNITCVSNITGLLLVRDGGNGDTNDTETFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1855 - protein, 690 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVITQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKAMYAPPISGQIRCSSNITGLLLTRDGGRGNQTDNQTEIFRPVGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1856 - protein, 684 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSAITQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQAMYAPPIKGNIACKSNITGLLLTRDGGRSNETNDTETFRPEGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1857 - protein, 692 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVITQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKAMYAPPIKGQISCSSNITGLLLTRDGGNNNSSGPETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1858 - protein, 684 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSAITQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRAIYAPPIPGVVKCKSNITGLILTRDGGDDENNTETFRPGGGNMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1859 - protein, 681 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQAMYAPPIQGVIRCQSNITGILLTRDGGNTGNNSRTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1860 - protein, 679 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSAITQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQAIYAPPIQGEIRCVSNITGLLLTRDGGNNNGTSETFRPEGGNMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1861 - protein, 698 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSAITQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQAMYAPPIPGVISCVSNITGLLLTRDGGGNNNTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1862 - protein, 669 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVIKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQAMYAPPISGAINCLSNITGILLTRDGGGNNRSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1863 - protein, 680 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1864 - protein, 686 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSAITQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQAMYAPPIAGNITCSSNITGLLLERDGGRDINNTEIFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1865 - protein, 700 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1866 - protein, 680 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1867 - protein, 787 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSAITQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRAMYAPPIAGNITCVSNITGLLLVRDGGNGDTNDTETFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1868 - protein, 797 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVITQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKAMYAPPISGQIRCSSNITGLLLTRDGGRGNQTDNQTEIFRPVGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1869 - protein, 791 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSAITQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQAMYAPPIKGNIACKSNITGLLLTRDGGRSNETNDTETFRPEGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1870 - protein, 799 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVITQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKAMYAPPIKGQISCSSNITGLLLTRDGGNNNSSGPETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1871 - protein, 791 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSAITQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRAIYAPPIPGVVKCKSNITGLILTRDGGDDENNTETFRPGGGNMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1872 - protein, 786 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSAITQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQAIYAPPIPGVIRCESNITGLILTSDYGNRSSDNETFRPTGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1873 - protein, 788 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSAITQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQAMYAPPIQGVIRCQSNITGILLTRDGGNTGNNSRTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1874 - protein, 786 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSAITQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQAIYAPPIQGEIRCVSNITGLLLTRDGGNNNGTSETFRPEGGNMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1875 - protein, 805 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSAITQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQAMYAPPIPGVISCVSNITGLLLTRDGGGNNNTNETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1876 - protein, 776 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVIKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQAMYAPPISGAINCLSNITGILLTRDGGGNNRSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1877 - protein, 788 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVIKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLAMYAPPISGRINCVSNITGILLTRDGGANNTSNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1878 - protein, 796 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVIKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQAMYAPPIRGSINCVSNITGILLTRDGGTNTSKNNETFRPGGGNIKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1879 - protein, 787 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1880 - protein, 791 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSAITQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRAMYAPPIEGNITCKSNITGLLLVRDGGVESNETEIFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1881 - protein, 778 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTITQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRAMYAPPIPGRITCNSSITGLILTRDGGENTTDNGTEIFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1882 - protein, 793 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSAITQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQAMYAPPIAGNITCSSNITGLLLERDGGRDINNTEIFRPGGGDMKNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1883 - protein, 807 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSAITQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRAMYAPPIAGKLTCRSNITGLLLVRDGGTNNATTETFRPGGGDMRNNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1884 - protein, 773 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTITQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRAMYAPPIEGNITCSSNITGLLLTRDGGLTNESKETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1885 - protein, 809 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTITQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRAMYASPIAGIITCKSNITGLLLTRDGGNKSAGIETFRPGGGNMKDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1886 - protein, 787 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSAITQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRAMYAPPIAGNITCKSHITGLLLVRDGGTGLNSSTETFRPGGGDMRDNWRSELYKYKVVKIEPLGVAPTRAKRRVVGGGSGGGGSGGAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1887 - protein, 673 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1888 - protein, 683 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1889 - protein, 677 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1890 - protein, 685 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1891 - protein, 677 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1892 - protein, 672 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1893 - protein, 674 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1894 - protein, 672 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1895 - protein, 691 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1896 - protein, 662 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1897 - protein, 674 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1898 - protein, 682 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1899 - protein, 673 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1900 - protein, 677 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1901 - protein, 679 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1902 - protein, 693 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1903 - protein, 659 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1904 - protein, 695 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1905 - protein, 673 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1906 - protein, 685 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1907 - protein, 695 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1908 - protein, 689 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1909 - protein, 697 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1910 - protein, 689 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1911 - protein, 684 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1912 - protein, 686 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1913 - protein, 684 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1914 - protein, 703 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1915 - protein, 674 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1916 - protein, 686 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1917 - protein, 694 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1918 - protein, 685 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1919 - protein, 689 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1920 - protein, 676 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1921 - protein, 691 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1922 - protein, 705 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1923 - protein, 671 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1924 - protein, 707 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1925 - protein, 685 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQ

SEQ ID NO: 1926 - protein, 792 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1927 - protein, 802 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1928 - protein, 796 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1929 - protein, 804 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1930 - protein, 796 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1931 - protein, 791 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1932 - protein, 793 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1933 - protein, 791 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1934 - protein, 810 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1935 - protein, 781 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1936 - protein, 793 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1937 - protein, 801 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1938 - protein, 792 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1939 - protein, 796 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1940 - protein, 783 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1941 - protein, 798 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1942 - protein, 812 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1943 - protein, 778 aa, Artificial Sequence
  Recombinant HIV protein
AENLWVTVYYGVPVWREAKTTLFCASDAKAYEREVHNVWATHACVPTDPNPQEMVLENVTENFNMWKNDMVDQMQEDIISLWDQSLKPCVKLTPLCVTLNCSKLNNATDGEMKNCSFNATTELRDKKKQVYALFYKLDIVPLDGRNNSSEYRLINCNTSTCTQACPKVSFDPIPIHYCAPAGYAILKCNNKTFNGTGPCHNVSTVQCTHGIKPVISTQLLLNGSTAEEDIIIRSENLTNNAKTIIVHLNESIEIECTRPGNNTRKSIRIGPGQAFFATTNIIGDIRQAYCIINKANWTNTLHRVSKKLEEHFPNKTINFNSSSGGDLEITTHSFNCGGEFFYCNTSSLFNGTYNDTDIYNSTDIILLCRIKQIINMWQEVGRCMYAPPIEGNITCSSNITGLLLTRDGGLTNESKETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1944 - protein, 814 aa, Artificial Sequence
  Recombinant HIV protein
AENLWVTVYYGVPVWKEAKATLFCASDAKAYEKEVHNVWATHACVPTDPNPQEIPLGNVTENFNMWKNDMADQMHEDIISLWDQSLKPCVKLTPLCVTLNCSDATSNTTKNATNTNTTSTDNRNATSNDTEMKGEIKDCTFNITTEVRDRKTKQRALFYKLDVVPLEEEKNSSSKNSSYKEYRLISCNTSTCTQACPKVSFDPIPIHYCAPAGYAILKCNNKTFNGTGPCHNVSTVQCTHGIKPVVSTQLLLNGSLAEEEIIIRSENLTDNTKTIIVHLNESVEIECVRPNNNTRKSVRIGPGQTFFATGEIIGDIRQAHCDLSKSNWTTTLKRIEKKLKEHFNNATIKFESSAGGDLEITTHSFNCRGEFFYCNTSGLFNSSLLNDTDGTSNSTSNATITLPCRIKQIINMWQEVGRCMYASPIAGIITCKSNITGLLLTRDGGNKSAGIETFRPGGGNMKDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1945 - protein, 792 aa, Artificial Sequence
  Recombinant HIV protein
AENLWVTVYYGVPVWKEAKATLFCASDAKAYETEVHNVWATHACVPTDPNPQEIVLENVTENFNMWENDMVNQMHEDVISLWDQSLKPCVKLTPLCVTLDCENVDGNDTYNGTNEMKNCSFNTTTELRDKKQKVSALFYRLDIVPLNRSSSSNSSDYYRLISCNTSACTQACPKVTFDPIPIHYCAPAGFAILKCNNKTFNGTGPCHNVSTVQCTHGIKPVVSTQLLLNGSLAEKEIIIRSKNLSDNVKTIIVHLNESVEIVCTRPNNNTRKSIRIGPGQTFYATGAIIGNIREAHCNISRDKWNETLQRVGKKLEEQFPNKTINFTSSSGGDLEITTHSFNCRGEFFYCNTSKLFNSTYIPTYRPNNTQGNSSSTITIPCRIKQIINMWQEVGRCMYAPPIAGNITCKSHITGLLLVRDGGTGLNSSTETFRPGGGDMRDNWRSELYKYKVVKIEPLGVAPTRCKRRVVGGGSGGGGSGGGGSGGAVGIGAVFLGFLGAAGSTMGAASMTLTVQARNLLSGIVQQQSNLLRAIEAQQHLLKLTVWGIKQLQARVLAVERYLRDQQLLGIWGCSGKLICCTNVPWNSSWSNRNLSEIWDNMTWLQWDKEISNYTQIIYGLLEESQNQQEKNEQDLLALDKWASLWNWFDISNWLWYIKIFIMIVGGLIGLRIVFAVLSVIHRVRQGYSPLSFQTHTPNPRGLDRPERIEEEDGEQDRGRSTRLVSGFLALAWDDLRSLCLFCYHRLRDFILIAARIVELLGHSSLKGLRLGWEGLKYLWNLLAYWGRELKIS

SEQ ID NO: 1946 - protein, 664 aa, Artificial Sequence
  Recombinant HIV protein
AENLWVTVYYGVPVWKEAKTTLFCASDAKAYEREVHNVWATHACVPTDPSPQEMVLENVTENFNMWKNDMVDQMHEDIISLWDQSLKPCVKLTPLCVTLKCVNVNATSKSNASATNDGSGEMKNCTFNITTEIRDKKRNESALFYKLDIVPLTNDNNSGEYRLINCNTSACTQACPKVSFDPIPIHYCAPAGYAILKCNNKTFNGTGPCYNVSTVQCTHGIKPVVSTQLLLNGSLAEGEIIIRSENLTDNVKTIIVHLNESIHITCTRPNNNTRKSIRIGPGQTFYATGEIIGDIRKAYCNISEEKWNKALQEVGKKLKEHFPNKTIKFAPSSGGDLEITTHSFNCRGEFFYCNTSKLFNSTYMHNATSRNATNATITLPCRIRQIINMWQEVGRCMYAPPIAGNITCVSNITGLLLVRDGGNGDTNDTETFRPGGGDMKNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1947 - protein, 674 aa, Artificial Sequence
  Recombinant HIV protein
AENLWVTVYYGVPVWKEANTTLFCASDAKAYNTEVHNVWATHACVPTDPNPQEVELENVTENFNMWKNNMVDQMHEDIISLWDQSLKPCVKLTPLCVTLSCTDNVGNDTSTNNSRWDKMEKGEIKNCSFNITTNMRDKMQKQYALFYKLDVVPIEEGKNNNSSFTDYRLISCNTSVCTQACPKVTFEPIPIHYCAPAGFALLKCKDKKFNGTGPCKNVSTVQCTHGIKPVVSTQLLLNGSLAEEEVVIRSENFSNNARTIIVQLNTSVEIKCIRPNNNTRKGIHIGPGRAFYTTGDIIGDIRQAHCNISRQNWNNTLKQIAEKLREQFGNKTIVFRNSSGGDPEIVMHTFNCAGEFFYCNTAELFNSTWYANGTISIGGGNKTNIILPCRIKQFINMWQEVGKCMYAPPISGQIRCSSNITGLLLTRDGGRGNQTDNQTEIFRPVGGDMKNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1948 - protein, 668 aa, Artificial Sequence
  Recombinant HIV protein
AENLWVTVYYGVPVWREANTTLFCASDAKAYDTEVHNVWATHACVPTDPKPQEVFLKNVTENFNMWKNEMVNQMHEDVISLWEQSLKPCVKLTPLCVTLKCNDVNSTSNGTSNGTDHKNMNEMKNCSFNTTTELRDRKKSEYALFYRLDIVPLDENSNEYILINCNTSACTQACPKVTFDPIPIHYCAPAGYAILKCNDTKFNGTGPCHNVSTVQCTHGIKPVVSTQLLLNGSLAEEEIMIRSENLTDNAKIIIVHLNQSVEINCTRPGNNTRRSIRIGPGQTFYATGDIIGDIRKAHCNISRERWNETVQRVVKKLAEHFPNKTIKFESSSGGDLEITTHSFNCGGEFFYCNTSGLFNGTYMPNGTKINDTERNLSSTITIPCRIKQIINMWQGVGQCMYAPPIKGNIACKSNITGLLLTRDGGRSNETNDTETFRPEGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1949 - protein, 676 aa, Artificial Sequence
  Recombinant HIV protein
AENLWVTVYYGVPVWKDASTTLFCASDAKAYDTEVHNVWATHACVPTDPNPQEVVLGNVTENFNMWKNNMVDQMHEDIISLWDQSLKPCVKLTPLCVTLNCTDNITNTNTNSSKNSSTHSYNNSLEGEMKNCSFNITAGIRDKVKKEYALFYKLDVVPIEEDKDTNKTTYRLRSCNTSVCTQACPKVTFEPIPIHYCAPAGFAILKCNDKKFNGTGPCTNVSTVQCTHGIRPVVSTQLLLNGSLAEEEVVIRSENFTNNAKTIIVQLNESIAINCTRPNNNTRRSIHIGPGRAFYATGDIIGDIRQAHCNISRTEWNSTLRQIVTKLREQLGDPNKTIIFNQSSGGDTEITMHSFNCGGEFFYCNTTKLFNSTWNGNNTTESDSTGENITLPCRIKQIINLWQEVGKCMYAPPIKGQISCSSNITGLLLTRDGGNNNSSGPETFRPGGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1950 - protein, 668 aa, Artificial Sequence
  Recombinant HIV protein
AENLWVTVYYGVPVWKDAETTLFCASDAKAYDKEVHNVWATHACVPTDPNPQEVHLENVTEEFNMWKNYMVEQMHTDIISLWDQSLQPCVKLTPLCVTLNCSHNINHNETTFSNDTNLPNITEEMRNCSFNMTTEVRDRQKQVYSLFYRLDIVQINEDQKEGSKGRYRLINCNTSACTQACPKVSFEPIPIHFCAPAGFAILKCKDKEFNGTGPCKNVSTVQCTHGIRPVVSTQLLLNGSLAEGKVMIRSENFTNNAKNIIVQFNESVEIECLRPNNNTRESIHLGPGRAFYARGGIIGDIRQAHCIVNKTNWNKALKEVAKQLRTIFNKTIKFTNSSGGDIEITTHSFNCRGEFFYCNTTGLFNLTWNGTDSTNRNESGNITLPCRIKQIINMWQRVGRCIYAPPIPGVVKCKSNITGLILTRDGGDDENNTETFRPGGGNMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1951 - protein, 663 aa, Artificial Sequence
  Recombinant HIV protein
AENLWVTVYYGVPVWKDAETTLFCASDAKAYEREVHNVWATHACVPTDPNPQEVIMENVTENFNMWKNNMVDQMHEDIISLWDQSLKPCVKLTPLCVTLDCRNVSDTRNGNVTYNNTMNEEIKNCSFNMTTELRDKKQKVSALFYRIDIVSLNSNSSDYRLINCNTSACTQACPKVSFEPIPIHYCAPAGYAILKCNNETFNGTGPCHNVSTVQCTHGIKPVVSTQLLLNGSLAKEQVMIRSEDITNSVKNIIVQFTEPVKINCTRPNNNTRKSVHIAPGQAFYATGDIIGNIRQAYCTVNRTAWSNTLQKVVTRLRTYFGNKTIIFKNSSGGDIEITTHSFNCAGEFFYCNTSSLFNSTWQVSGQGLNSTELGDTITLQCRIKQIINMWQRAGQCIYAPPIPGVIRCESNITGLILTSDYGNRSSDNETFRPTGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1952 - protein, 665 aa, Artificial Sequence
  Recombinant HIV protein
AENLWVTVYYGVPVWKNAETTLFCASDAKAYKTEVHNVWATHACVPTDPNPQEIHLENVTEEFNVWKNNMVEQMHTDIISLWDQSLKPCVKLTPLCVTLNCINANVTNSSMTNSSMMEGEIKNCSYNMTTELRDKKRKVFSLFYKLDVVPMNENNSEYRLINCNTSACTQACPKVTFEPIPIHYCAPAGFAILKCKDEEFNGTGLCKNVSTVQCTHGIKPVVSTQLLLNGSLAEKEIRIKSENISDNAKTIIVQLTKPVLINCARPSNNTRKSVHIGPGQAFYATGAITGDIRQAYCVVNRTQWNDTLGQVAIQLRKHWNTTIIFNEPSGGDLEITTHSFNCGGEFFYCNTSDLFNSTWNIEGTASINGTESNDNITLPCRIKQIINMWQRVGQCMYAPPIQGVIRCQSNITGILLTRDGGNTGNNSRTNETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1953 - protein, 663 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLECRNITGVNITEGKEEIKNCSFNITTELRDKWQKVYSLFYRLDVVQIDEGDKNSTQYRLINCNTSACTQACPKVTFEPIPIHYCAPAGFAILKCNDKEFNGTGPCKNVSTVQCTHGIRPVISTQLLLNGSLAEKEVRIRSENITNNAKTIIVQFTESVKINCTRPGNNTRKSIRIGPGQTFYARGDIIGDIRQAYCKVNRSEWNKTLQKVAKQLGKYFGNKTVIFNSSSGGDLEITTHSFNCGGEFFYCNTSGLFNSTWTWNTSTWNQVNSTESNDTIILQCRIKQIINMWQRTGQCIYAPPIQGEIRCVSNITGLLLTRDGGNNNGTSETFRPEGGNMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1954 - protein, 682 aa, Artificial Sequence
  Recombinant HIV protein
AENLWVTVYYGVPVWRDADTTLFCASDAKAYETEKHNVWATHACVPTDPNPQEIHLDNVTEKFNMWKNNMVEQMHTDIISLWDQSLKPCVKLTPLCVTLHCTNFNPNSTRNGSNDTDRGEGGNNTVTNREEIKNCSFNMTTELRDRKRKVHSLFYKLDIVQINKNQSQDNGSEYRLINCNTSACTQACPKVSFEPIPIHYCAPAGFAILKCKDEEFNGTGPCKNVSTVQCTHGIKPVVSTQLLLNGSLAEKEVKIRSENITNNVKTIIVQLVNPVIINCTRPNNNTRKSIRIGPGQSFYATDIIGDIRQAHCNVSRSDWNKTLQQVARQLRKHFVNKTIIFTNSSGGDLEVTTHSFNCGGEFFYCSTSGLFNSTWDSSTWDSNSTQANITELNENITLPCRIRQIINMWQRTGQCMYAPPIPGVISCVSNITGLLLTRDGGGNNNTNETFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1955 - protein, 653 aa, Artificial Sequence
  Recombinant HIV protein
AENLWVTVYYGVPVWRDADTTLFCASDAKAHETEVHNVWATHACVPTDPNPQEIHLVNVTENFNMWKNKMVEQMQEDVISLWDESLKPCVKLTPLCVTLNCTTANTNETKNNTTDDNIKDEMKNCTFNMTTEIRDKKQRVSALFYKLDIVPIDDSKNNSEYRLINCNTSVCKQACPKVSFDPIPIHYCTPAGYVILKCNDKNFNGTGPCKNVSSVQCTHGIKPVVSTQLLLNGSLAEEEIIIRSENLTDNAKNIIVHLNKSVEINCTRPSNNTRTSVRIGPGQVFYRTGDITGDIRKAYCEIDGTEWNKTLTQVAEKLKEHFNKTIVYQPPSGGDLEITMHHFNCRGEFFYCNTTQLFNNSVGNSTIKLPCRIKQIINMWQGVGQCMYAPPISGAINCLSNITGILLTRDGGGNNRSNETFRPGGGNIKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1956 - protein, 665 aa, Artificial Sequence
  Recombinant HIV protein
AENLWVTVYYGVPVWRDADTTLFCASDAKAHETEVHNVWATHACVPTDPNPQEIHLENITENFNMWKNNMVEQMQEDVISLWDQSLKPCVKLTPLCVTLNCINANLTNVNNIIHGPNIIGNITDEVRNCSFNMTTEIRDKKQKVHALFYKLDLVQIEDKNSSEYRLINCNTSVCKQACPKISFDPIPIHYCTPAGYAILKCNDKNFNGTGPCTNVSSVQCTHGIKPVVSTQLLLNGSLAEEEIIIRSENLTNNAKTIIVHLNKSVEINCTRPSNNTRTSTTIGPGQVFYRTGDITGNIRKAYCEINGTKWNEALKQVTKKLKEHFNNKTIIFQPPSGGDLEITMHHFNCRGEFFYCNTTRLFNNTCIGNETIGGCNDTIILPCKIKQIINMWQGAGLCMYAPPISGRINCVSNITGILLTRDGGANNTSNETFRPGGGNIKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1957 - protein, 673 aa, Artificial Sequence
  Recombinant HIV protein
AENLWVTVYYGVPVWRDADTTLFCASDAKAHETEAHNVWATHACVPTDPSPQEIHLENVTENFNMWKNNMVEQMQEDVISLWDQSLKPCVKLTPLCVTLNCTNAKLTKVSNTTDDVPSIVGNVTDEIKNCSFNMTTELRDKKQSVHALFYKLDIVPMKDPDSSNSTKYRLINCNTSVCKQACPKISFDPIPIHYCTPAGYAILKCNEKNFTGTGPCKNVSSVQCTHGIKPVVSTQLLLNGSLAEDEIIIRSENLTDNTKTIIVHLNKSVEINCTRPSNNTRTSMTIGPGQVFYRTGDIVGNIRKAYCVINGTIWNKVLKQVADKLKEHFNKTTVFQPPSGGDLEITMHHFNCRGEFFYCNTTKLFNNTCINDTRNNETEEECKNNIILPCKIKQIINMWQRVGQCMYAPPIRGSINCVSNITGILLTRDGGTNTSKNNETFRPGGGNIKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1958 - protein, 664 aa, Artificial Sequence
  Recombinant HIV protein
AENLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTCTQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRCMYAPPIEGNITCKSNITGLLLTWDGGENSTEGVFRPGGGNMKDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1959 - protein, 668 aa, Artificial Sequence
  Recombinant HIV protein
AENLWVTVYYGVPVWKEAKTTLFCASDAKAYEKEVHNVWATHACVPTDPNPQEMVLENVTENFNMWKNDMVEQMHEDVISLWDQSLKPCVKLTPLCVTLECRQVNTTNATSSVNVTNGEEIKNCSFNATTEIRDKKQKVYALFYRLDIVPLEEERKGNSSKYRLINCNTSACTQACPKVTFDPIPIHYCAPAGYAILKCNNKTFNGTGPCNNVSTVQCTHGIKPVVSTQLLLNGSLAEGEIIIRSENLTNNVKTIIVHLNESVEIVCTRPNNNTRKSIRIGPGQTFYATGDIIGNIRQAYCNIKKDDWIRTLQRVGKKLAEHFPRRIINFTSPAGGDLEITTHSFNCRGEFFYCNTSSLFNSTYNPNDTNSNSSSSNSSLDITIPCRIKQIINMWQEVGRCMYAPPIEGNITCKSNITGLLLVRDGGVESNETEIFRPGGGDMRNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1960 - protein, 655 aa, Artificial Sequence
  Recombinant HIV protein
AENLWVTVYYGVPVWKEAKTTLFCASDAKAYEREVHNVWATHACVPTDPNPQEMVLENVTENFNMWKNDMVDQMHEDIISLWDESLKPCVKLTPLCVTLNCTFITNTTEIKNCTFNMTTELRDIKQQGRALFDTLDIVPLKPPNNSSNYSEYRLISCNTSTCTQACPKVSFDPIPIHYCAPAGYAILKCNNKTFNGLGPCNNVSTVQCTHGIKPVVSTQLLLNGSLAEEEIIIRSENLTNNVKTIIVHLNEPVYIVCTRPNNNTRKSMRIGPGQTFYATGDIIGDIRQAHCNISIEKWNTTLEKVKERLKKHFPNKIIKFEPSSGGDLEITTHSFNCRGEFFYCNTANLFNETFMNQTDANQTNATITLQCRIKQIINMWQGVGRCMYAPPIPGRITCNSSITGLILTRDGGENTTDNGTEIFRPGGGDMRDNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1961 - protein, 670 aa, Artificial Sequence
  Recombinant HIV protein
AENLWVTVYYGVPVWKEATTTLFCASDAKAYDTEVHNVWATHACVPTDPNPQEMVLENVTENFNMWKNEMINQMHEDVVSLWDQSLKPCVKLTPLCVTLKCRNVSDSRNGNSTYNESEQEMKNCSFNVTTILRDKKKKVDALFYKLDIVPLHKKKNSKNNSIEYYRLINCNTSACTQACPKVTFDPIPIHYCTPAGYAILKCNDKTFNGTGPCHNVSTVQCTHGIKPVVSTQLLLNGSLAEGEIIIRSENLTDNVKTIIVHLNKSVEIVCTRPNNNTRKSIRIGPGQTFYATDIIGDIRQAYCNINRTMWTQTLQRVSEKLAEHFPNKTINFTSSSGGDLEIATHSFNCRGEFFYCNTSGLFNSTYMPNGTYMHSGAESNSSLITIPCRIKQIINMWQEVGQCMYAPPIAGNITCSSNITGLLLERDGGRDINNTEIFRPGGGDMKNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

SEQ ID NO: 1962 - protein, 684 aa, Artificial Sequence
  Recombinant HIV protein
AENLWVTVYYGVPVWKEAKTTLFCASDAKAYETEVHNVWATHACVPTDPNPQEMVLENVTENFNMWKNEMATQMHEDVISLWDQSLKPCVKLTPLCVTLDCKNVTLNCGNDTSGNDTLECEKGTNNETYDESVKELRNCSFNATTEVRDKKQKKYALFYSLDIVPLKNSSEQYRLISCDTSACTQACPKVTFDPIPIHYCTPAGYAILKCNNKTFNGTGPCNNVSTVQCTHGIKPVVSTQLLLNGSLAEEEIIVRSENITNNVKTIIVHLNQSVEIVCTRPNNNTRKSIRIGPGQTFYATGEIIGDIRQAHCNITKSNWHKTLQEVSKKLAGYFPNKTIIFNSSSGGDLEITTHSFNCRGEFFYCNTSSLFNSTYMSNGTYMFNDMSNGTERNSSSIIAIPCRIKQVINMWQEVGRCMYAPPIAGKLTCRSNITGLLLVRDGGTNNATTETFRPGGGDMRNNWRSELYKYKVVKIEPLGVAPTRAKRRVVGRRRRRRAVGIGAVFLGFLGAAGSTMGAASMTLTVQARNLLSGIVQQQSNLLRAPEAQQHLLKLTVWGIKQLQARVLAVERYLRDQQLLGIWGCSGKLICTTNVPWNSSWSNRNLSEIWDNMTWLQWDKEISNYTQIIYGLLEESQNQQEKNEQDLLALDSGGSGGSGGGSILAIYSTVASSLVLLVSLGAISF

(The sequence listing continues in the following parts.)

We claim:

1. An isolated immunogen, comprising:
a recombinant HIV-1 Env ectodomain trimer stabilized in a prefusion mature closed conformation by one or more amino acid substitutions compared to a native HIV-1 Env sequence, wherein the one or more amino acid substitutions comprise cysteine substitutions to introduce a non-natural disulfide bond between at HIV-1 Env positions 201 and 433 that stabilizes the HIV-1 Env ectodomain trimer in the prefusion mature closed conformation, wherein the HIV-1 Env positions correspond to a HXB2 reference sequence set forth as SEQ ID NO: 1; wherein
the recombinant HIV-1 Env ectodomain trimer comprises three gp120-gp41 protomers comprising a gp120 polypeptide and a gp41 ectodomain; and
the recombinant HIV-1 Env ectodomain trimer does not specifically bind to a 17b antibody when incubated with a molar excess of sCD4.

2. The immunogen of claim 1, wherein:
the N-terminal residue of the gp120 polypeptide is one of HIV-1 Env positions 1-35;
the C-terminal residue of the gp120 polypeptide is one of HIV-1 Env positions 503-512;
the N-terminal residue of the gp41 ectodomain is one of HIV-1 Env positions 512-522; and/or
the C-terminal residue of the gp41 ectodomain is one of HIV-1 Env positions 624-705, and
wherein the HIV-Env positions correspond to a HXB2 reference sequence set forth as SEQ ID NO: 1.

3. The immunogen of claim 2, wherein the gp120 polypeptide comprises or consists of HIV-1 Env positions 31-507, and the gp41 ectodomain comprises or consists of HIV-1 Env positions 512-664, wherein the HIV-Env positions correspond to a HXB2 reference sequence set forth as SEQ ID NO: 1.

4. The immunogen of claim 1, wherein the gp120 polypeptide and the gp41 ectodomain comprise amino acid sequences of HIV-1 Env positions 31-511 and 512-664 (HXB2 numbering), respectively, of the HIV-1 Env amino acid sequence set forth as SEQ ID NO: 2 (BG505), SEQ ID NO: 51 (CAP256.SU), SEQ ID NO: 81 (BB201.B42), SEQ ID NO: 107 (KER2018.11), SEQ ID NO: 174 (CH070.1), SEQ ID NO: 745 (ZM233.6), SEQ ID NO: 746 (Q23.17), SEQ ID NO: 747 (A244), SEQ ID NO: 2114 (T250-4), or SEQ ID NO: 748 (WITO.33), further comprising the one or more amino acid substitutions that stabilize the HIV-1 Env ectodomain trimer in the prefusion mature closed conformation, or sequences at least 80% identical thereto that comprise the one or more one amino acid substitutions that stabilize the recombinant HIV-1 Env ectodomain in the prefusion mature closed conformation.

5. The immunogen of claim 1, wherein the recombinant HIV-1 Env ectodomain trimer is a chimera comprising amino acid sequences from at least two HIV-1 strains, wherein
the gp41 ectodomain, an N-terminal region of the gp120 polypeptide comprising a β-4 strand, and a C-terminal region of the gp120 polypeptide comprising a β26 strand, are from a first strain of HIV-1; and
the remaining sequence of the gp120 polypeptide are from a heterologous strain of HIV-1; and
the sequences of the first and heterologous strains have been modified to comprise one or more amino acid substitutions that stabilize the recombinant HIV-1 Env ectodomain trimer in the prefusion mature closed conformation.

6. The immunogen of claim 1, wherein the recombinant HIV-1 Env ectodomain trimer is a chimera comprising amino acid sequences from at least two HIV-1 strains, wherein the recombinant HIV-1 Env ectodomain trimer comprises a V1V2 domain of an HIV-1 Env protein from a heterologous HIV-1 strain, and the remainder of the recombinant HIV-1 Env ectodomain is from a first strain of HIV-1.

7. The immunogen of claim 1, wherein the recombinant HIV-1 Env ectodomain trimer is a chimera comprising amino acid sequences from at least three HIV-1 strains, wherein
the gp41 ectodomain, an N-terminal region of the gp120 polypeptide comprising a β-4 strand, and a C-terminal region of the gp120 polypeptide comprising a β26 strand, are from a first strain of HIV-1;
a V1V2 domain of the gp120 polypeptide is from a second strain of HIV-1; and
the remaining sequence of the gp120 polypeptide is from a heterologous strain of HIV-1; and
the sequences of the first, second, and heterologous strains have been modified to comprise the one or more amino acid substitutions that stabilize the recombinant HIV-1 Env ectodomain trimer in the prefusion mature closed conformation.

8. The immunogen of claim 1, wherein the one or more amino acid substitutions that stabilize the HIV-1 Env ectodomain trimer in the prefusion mature closed conformation further comprise:

one of the following substitutions: 66P, 68P, 70F, 70Y, 71P, 75F, 75W, 75M, 111F, 111Y, 112I, 120T, 154W, 154F, 159Y, 164F, 172F, 202F, 204W, 204F, 208F, 208W, 223W, 302F, 307F, 307W, 309W, 315F, 316W, 323Y, 423F, 427M, 429N, 430W, 430F, 432F, 432W, 436W, 544Y, 580L, 583L, and 594N; or
one of the following sets of substitutions: 154F, 300L, 302M, and 320L substitutions,
159Y and 323Y substitutions, 544Y and 537Y substitutions, 120F and 315M substitutions, 177W and 420M substitutions, 580L and 583L substitutions, 573T and 594N substitutions, and 304C and 440C substitutions: and
wherein the HIV-Env positions correspond to a HXB2 reference sequence set forth as SEQ ID NO: 1.

9. The immunogen of claim 1, wherein the one or more amino acid substitutions that stabilize the HIV-1 Env ectodomain trimer in the prefusion mature closed conformation further comprise:
  (a) a non-natural disulfide bond between cysteine substitutions at HIV-1 Env positions 501 and 605;
  (b) a proline substitution at HIV-1 Env position 559; or
  (c) a combination of (a) and (b); and
  wherein the HIV-Env positions correspond to a HXB2 reference sequence set forth as SEQ ID NO: 1.

10. The immunogen of claim 1, wherein:
the recombinant HIV-1 Env ectodomain further comprises one or more amino acid substitutions that introduce an N-linked glycosylation site at one of HIV-1 Env position 33, 35, 502, 504, 658, or 661, or a combination of two or more thereof; and wherein the HIV-Env positions correspond to a HXB2 reference sequence set forth as SEQ ID NO: 1.

11. The immunogen of claim 1, wherein the gp120-gp41 protomers are single chain HIV-1 Env ectodomains, and wherein the N-terminal residue of the gp120 polypeptide is linked to the C-terminal residue of the gp41 ectodomain by a heterologous peptide linker.

12. The immunogen of claim 11, wherein
the heterologous peptide linker joins gp120 and gp41 at HIV-1 -Env positions 507 and 512, 503 and 519, 504 and 519, 503 and 522, or 504 and 522, respectfully, wherein the HIV-Env positions correspond to a HXB2 reference sequence set forth as SEQ ID NO: 1.

13. The immunogen of claim 1, wherein the gp120-gp41 protomers in the recombinant HIV-1 Env ectodomain trimer are linked to a transmembrane domain.

14. The immunogen of claim 9, comprising the combination of
  cysteine substitutions at positions 501 and 605 to introduce a disulfide bond in the HIV-1 Env ectodomain trimer; and
  a proline substitution at position 559.

15. The immunogen of claim 1, wherein the gp120-gp41 protomers in the recombinant HIV-1 Env ectodomain trimer comprise the amino acid sequence set forth as SEQ ID NO: 26.

16. The immunogen of claim 1, further comprising a D368R substitution, an N-linked glycosylation site at HIV-1 Env position 332, an R6 substitution, or a combination thereof, wherein the HIV-Env positions correspond to a HXB2 reference sequence set forth as SEQ ID NO: 1.

17. The immunogen of claim 1, wherein the gp120-gp41 protomers in the recombinant HIV-1 Env ectodomain trimer comprise:
the amino acid sequence set forth as one of SEQ ID NO: 856, 857, 858, 859, 860, 862, 865, 866, 868, 869, 870, 871, 872, 874, 877, 878, 879, 881, 882, 883, 886, 887, 888, 890, 894, 898, 901, 902, 903, 906, 907, 908, 912, 917, 918, 921, 922, 924, 927, 928, 929, 930, 932, 933, 937, 938, 939, 940, 941, 945, 948, 950, 951, 952, 953, 956, 958, 961, 962, 964, 965, 966, 970, 971, 973, 978, 990, 993, 997, 1001, 1005, 1010, 1014, 1016, 1017, 1020, 1021, 1023, 1025, 1026, 1028, 1029, 1033, 1034, 1035, 1041, 1044, 1047, 1054, 1055, 1060, 1061, 1062, 1075, 1076, 1082, 1083, 1086, 1091, 1092, 1094, 1095, 1097, 1098, 1253, 1258, 1260, 1273, 1274, 1275, 1277, 1290, 1292, 1293, 1294, 1298, 1299, 1300, 1302, 1303, 1304, 1305, 1306, 1309, 1316, 1317, 1318, 1319, 1320, 1321, 1321, 1322, 1325, 1326, 1327, 1328, 1329, 1330, 1331, 1335, 1337, 1340, 1341, 1346, 1347, 1350, 1351, 1352, 1353, 1355, 1356, 1357, 1363, 1364, 1403, 1408, 1413, 1412, 1415, 1425, 1434, 1460, 1461, 1510, 1534, 1541, 1545, 1560, 1561, 1567, 1572, 1573, 1577, 1735, 1736, 1738, 1739, 1740, 1741, 1744, 1758, 1759, 1760, 1763, 2117, or an amino acid sequence at least 90% identical thereto that comprises the one or more amino acid substitutions that stabilize the HIV-1 Env ectodomain trimer in the prefusion mature closed conformation.

18. The immunogen of claim 1, wherein the gp120-gp41 protomers in the recombinant HIV-1 Env ectodomain trimer are linked to trimerization domains.

19. An isolated nucleic acid molecule encoding the recombinant HIV-1 Env ectodomain trimer of claim 1.

20. The nucleic acid molecule of claim 19, wherein the nucleic acid molecule encodes a precursor protein of the gp120/gp41 protomers in the recombinant HIV-1 Env ectodomain trimer.

21. The nucleic acid molecule of claim 19, operably linked to a promoter.

22. A vector comprising the nucleic acid molecule of claim 21.

23. An isolated host cell comprising the vector of claim 22.

24. An immunogenic composition comprising an effective amount of the immunogen of claim 1, and a pharmaceutically acceptable carrier.

25. The immunogenic composition of claim 24, further comprising an adjuvant.

26. A method for generating an immune response to Human Immunodeficiency Virus type 1 (HIV-1) gp120 in a subject, comprising administering to the subject an effective amount of the immunogenic composition of claim 24, thereby generating the immune response.

27. The method of claim 26, comprising a prime-boost administration of the immunogenic composition.

28. A method for detecting or isolating an antibody that specifically binds to HIV-1 Env from a subject, comprising:
  providing an effective amount of the immunogen of claim 1;
  contacting a biological sample from the subject with the immunogen under conditions sufficient to form an immune complex between the immunogen and the antibody that specifically binds to HIV-1 Env; and
  detecting the immune complex, thereby detecting or isolating the antibody from the subject.

29. The method of claim 26, wherein the subject is at risk of or has an HIV-1 infection.

30. The immunogen of claim 1, wherein the HIV-1 Env ectodomain trimer specifically binds to PGT145 mAb and/or VRC26 mAb.

31. The immunogen of claim 18, wherein the trimerization domains are Foldon domains.

32. The immunogen of claim 6, wherein the V1V2 domain is HIV-1 Env positions 126-196, wherein the HIV-Env positions correspond to a HXB2 reference sequence set forth as SEQ ID NO: 1.

33. The immunogen of claim 1, wherein the cysteine substitutions to introduce a non-natural disulfide bond between at HIV-1 Env positions 201 and 433 are I201C and A433C substitutions.

34. The immunogen of claim 9, wherein
the cysteine substitutions to introduce a non-natural disulfide bond between at HIV-1 Env positions 501 and 605 are A501C and T605C substitutions; and
the proline substitution at HIV-1 Env position 559 is a I559P substitution.

35. The immunogen of claim 9, wherein
the cysteine substitutions to introduce a non-natural disulfide bond between at HIV-1 Env positions 201 and 433 are I201C and A433C substitutions;
the cysteine substitutions to introduce a non-natural disulfide bond between at HIV-1 Env positions 501 and 605 are A501C and T605C substitutions; and
the proline substitution at HIV-1 Env position 559 is a I559P substitution.

36. The immunogen of claim 1, wherein the one or more amino acid substitutions that stabilize the HIV-1 Env ectodomain trimer in the prefusion mature closed conformation further comprise:
a methionine substitution at HIV-1 Env position 154;
a methionine substitution at HIV-1 Env position 300;
a methionine substitution at HIV-1 Env position 302;
a leucine substitution at HIV-1 Env position 320;
cysteine substitutions to introduce a non-natural disulfide bond between HIV-1 Env positions 501 and 605, and
a proline substitution at HIV-1 Env position 559,
wherein the HIV-Env positions correspond to a HXB2 reference sequence set forth as SEQ ID NO: 1.

37. The immunogen of claim 36, wherein
the cysteine substitutions to introduce a non-natural disulfide bond between at HIV-1 Env positions 201 and 433 are I201C and A433C substitutions;
the methionine substitution at HIV-1 Env position 154 is a L154M substitution;
the methionine substitution at HIV-1 Env position 300 is a N300M substitution;
the methionine substitution at HIV-1 Env position 302 is a N302M substitution;
the leucine substitution at HIV-1 Env position 320 is aT320L substitution;
the cysteine substitutions to introduce a non-natural disulfide bond between at HIV-1 Env positions 501 and 605 are A501C and T605C substitutions; and
the proline substitution at HIV-1 Env position 559 is a I559P substitution.

38. The immunogen of claim 36, wherein the gp120 polypeptide and the gp41 ectodomain in the protomers in the HIV-1 Env ectodomain trimer comprise or consist of HIV-1 Env positions 31-507, and 512-664, respectively, wherein the HIV-Env positions correspond to a HXB2 reference sequence set forth as SEQ ID NO: 1.

39. The immunogen of claim 36, wherein the gp120-gp41 protomers in the recombinant HIV-1 Env ectodomain trimer comprise the amino acid sequence set forth as SEQ ID NO: 1252, or an amino acid sequence at least 90% identical thereto that comprises the one or more amino acid substitutions that stabilize the HIV-1 Env ectodomain trimer in the prefusion mature closed conformation.

40. The immunogen of claim 36, wherein the one or more amino acid substitutions that stabilize the HIV-1 Env ectodomain trimer in the prefusion mature closed conformation further comprise:
a tryptophan substitution at HIV-1 Env position 177
a methionine substitution at HIV-1 Env position 420; and
wherein the HIV-Env positions correspond to a HXB2 reference sequence set forth as SEQ ID NO: 1.

41. The immunogen of claim 40, wherein
the cysteine substitutions to introduce a non-natural disulfide bond between at HIV-1 Env positions 201 and 433 are I201C and A433C substitutions;
the methionine substitution at HIV-1 Env position 154 is a L154M substitution;
the tryptophan substitution at HIV-1 Env position 177 is a Y177W substitution
the methionine substitution at HIV-1 Env position 300 is a N300M substitution;
the methionine substitution at HIV-1 Env position 302 is a N302M substitution;
the leucine substitution at HIV-1 Env position 320 is aT320L substitution;
a methionine substitution at HIV-1 Env position 420 is a I420M substitution;
the cysteine substitutions to introduce a non-natural disulfide bond between at HIV-1 Env positions 501 and 605 are A501C and T605C substitutions; and
the proline substitution at HIV-1 Env position 559 is a I559P substitution.

42. The immunogen of claim 40, wherein the gp120 polypeptide and the gp41 ectodomain in the protomers in the HIV-1 Env ectodomain trimer comprise or consist of HIV-1 Env positions 31-507, and 512-664, respectively, wherein the HIV-Env positions correspond to a HXB2 reference sequence set forth as SEQ ID NO: 1.

43. The immunogen of claim 40, wherein the gp120-gp41 protomers in the recombinant HIV-1 Env ectodomain trimer comprise the amino acid sequence set forth as SEQ ID NO: 1269, or an amino acid sequence at least 90% identical thereto that comprises the one or more amino acid substitutions that stabilize the HIV-1 Env ectodomain trimer in the prefusion mature closed conformation.

44. The immunogen of claim 4, wherein the one or more amino acid substitutions that stabilize the HIV-1 Env ectodomain trimer in the prefusion mature closed conformation further comprise cysteine substitutions to introduce a non-natural disulfide bond between HIV-1 Env positions 501 and 605, and a proline substitution at HIV-1 Env position 559, wherein the HIV-Env positions correspond to a HXB2 reference sequence set forth as SEQ ID NO: 1.

45. The immunogen of claim 5, wherein the one or more amino acid substitutions that stabilize the HIV-1 Env ectodomain trimer in the prefusion mature closed conformation further comprise cysteine substitutions to introduce a non-natural disulfide bond between HIV-1 Env positions 501 and 605, and a proline substitution at HIV-1 Env position 559, wherein the HIV-Env positions correspond to a HXB2 reference sequence set forth as SEQ ID NO: 1.

46. The immunogen of claim 6, wherein the one or more amino acid substitutions that stabilize the HIV-1 Env ectodomain trimer in the prefusion mature closed conformation further comprise cysteine substitutions to introduce a non-natural disulfide bond between HIV-1 Env positions 501 and 605, and a proline substitution at HIV-1 Env position 559, wherein the HIV-Env positions correspond to a HXB2 reference sequence set forth as SEQ ID NO: 1.

47. The immunogen of claim 7, wherein the one or more amino acid substitutions that stabilize the HIV-1 Env ectodomain trimer in the prefusion mature closed conformation further comprise cysteine substitutions to introduce a non-natural disulfide bond between HIV-1 Env positions 501 and 605, and a proline substitution at HIV-1 Env position 559, wherein the HIV-Env positions correspond to a HXB2 reference sequence set forth as SEQ ID NO: 1.

48. The immunogen of claim 8, wherein the one or more amino acid substitutions that stabilize the HIV-1 Env ectodomain trimer in the prefusion mature closed conformation further comprise cysteine substitutions to introduce a non-natural disulfide bond between HIV-1 Env positions 501 and 605, and a proline substitution at HIV-1 Env position 559, wherein the HIV-Env positions correspond to a HXB2 reference sequence set forth as SEQ ID NO: 1.

49. The immunogen of claim 10, wherein the one or more amino acid substitutions that stabilize the HIV-1 Env ectodomain trimer in the prefusion mature closed conformation further comprise cysteine substitutions to introduce a non-natural disulfide bond between HIV-1 Env positions 501 and 605, and a proline substitution at HIV-1 Env position 559, wherein the HIV-Env positions correspond to a HXB2 reference sequence set forth as SEQ ID NO: 1.

50. The immunogen of claim 11, wherein the one or more amino acid substitutions that stabilize the HIV-1 Env ectodomain trimer in the prefusion mature closed conformation further comprise cysteine substitutions to introduce a non-natural disulfide bond between HIV-1 Env positions 501 and 605, and a proline substitution at HIV-1 Env position 559, wherein the HIV-Env positions correspond to a HXB2 reference sequence set forth as SEQ ID NO: 1.

51. The immunogen of claim 16, wherein the one or more amino acid substitutions that stabilize the HIV-1 Env ectodomain trimer in the prefusion mature closed conformation further comprise cysteine substitutions to introduce a non-natural disulfide bond between HIV-1 Env positions 501 and 605, and a proline substitution at HIV-1 Env position 559, wherein the HIV-Env positions correspond to a HXB2 reference sequence set forth as SEQ ID NO: 1.

* * * * *